United States Patent 12,606,815 (SELF-DIVERSIFYING SYSTEMS AND METHODS OF USE THEREOF) - sequence listing, part 5

SEQ ID NO: 1617 - DNA, 4000 bp, Escherichia coli
  misc_feature (104)..(104): n is a, c, g, or t
  misc_feature (351)..(351): n is a, c, g, or t
  misc_feature (363)..(363): n is a, c, g, or t
  misc_feature (582)..(582): n is a, c, g, or t
  misc_feature (584)..(585): n is a, c, g, or t
  misc_feature (1944)..(1944): n is a, c, g, or t
  misc_feature (1989)..(1989): n is a, c, g, or t
  misc_feature (2317)..(2317): n is a, c, g, or t
  misc_feature (2390)..(2390): n is a, c, g, or t
  misc_feature (2392)..(2392): n is a, c, g, or t
  misc_feature (2674)..(2674): n is a, c, g, or t
  misc_feature (2689)..(2689): n is a, c, g, or t
  misc_feature (2716)..(2716): n is a, c, g, or t
  misc_feature (2722)..(2722): n is a, c, g, or t
  misc_feature (2731)..(2731): n is a, c, g, or t
  misc_feature (2887)..(2887): n is a, c, g, or t
  misc_feature (2968)..(2968): n is a, c, g, or t
  misc_feature (3010)..(3010): n is a, c, g, or t
  misc_feature (3079)..(3079): n is a, c, g, or t
  misc_feature (3104)..(3104): n is a, c, g, or t
  misc_feature (3106)..(3106): n is a, c, g, or t
  misc_feature (3184)..(3184): n is a, c, g, or t
  misc_feature (3190)..(3190): n is a, c, g, or t
  misc_feature (3197)..(3197): n is a, c, g, or t
  misc_feature (3202)..(3202): n is a, c, g, or t
  misc_feature (3316)..(3316): n is a, c, g, or t
  misc_feature (3322)..(3322): n is a, c, g, or t
  misc_feature (3327)..(3327): n is a, c, g, or t
  misc_feature (3416)..(3416): n is a, c, g, or t
  misc_feature (3424)..(3424): n is a, c, g, or t
  misc_feature (3429)..(3429): n is a, c, g, or t
  misc_feature (3433)..(3433): n is a, c, g, or t
  misc_feature (3445)..(3445): n is a, c, g, or t
  misc_feature (3527)..(3527): n is a, c, g, or t
  misc_feature (3562)..(3562): n is a, c, g, or t
  misc_feature (3625)..(3625): n is a, c, g, or t
  misc_feature (3634)..(3634): n is a, c, g, or t
  misc_feature (3658)..(3658): n is a, c, g, or t
  misc_feature (3859)..(3859): n is a, c, g, or t
  misc_feature (3873)..(3873): n is a, c, g, or t
  misc_feature (3877)..(3877): n is a, c, g, or t
  misc_feature (3879)..(3879): n is a, c, g, or t
  misc_feature (3890)..(3890): n is a, c, g, or t
  misc_feature (3964)..(3964): n is a, c, g, or t
  misc_feature (3976)..(3976): n is a, c, g, or t
  misc_feature (3985)..(3985): n is a, c, g, or t
ccattctggagacttgctgccgctcgatattgatctgtaccttacttgcaacttcaagtgtaatccggtcgtctcccacttttactattgttccaaagattccnccgtttgtgacaaccttgtcacccttgttaagactgtctaccattcgctggtgtgctttctgttttttttgttgtggacggataattagaaaccagaaaactcctaggattaatacaagtgggataaattggaaaaaaggactctgtgaagacgcctctcccgcggattgggcatatgcaactgattcaaatggaaacatctaattaactcctttaaaggtttatgggtaaataaaacaataaagtntagcacttcatnaaaaatatttcacgtctaaatgcgcaatttccaaaatttatttatctctcataaaatgttggaatagcaaatagtctgatttcaacacacctcacggcagttgatttgtaaagggctttcactccttcggtttccgcagcgtgttgctgcggaagcatacatctgtaatcataaaattcgtaaaatcgagtagcgaagtgattctcacggttgttgcangnncttcgcccctacgctttcacgccttcaaaaaagggaacactacttttcattaatgaacttgtaataaaattgtcattcccgcggaagcgggaatacaggagtggggtttatacggctgaataaaacttaaatcatagatgggttaggagaagcccattcctttcccctgcacggcctttcgacggcgcttcacttcgccaccgctcaggctccggaaaagttcgccggggctaccgttccggaattgttccttgtcattggtttcccccgctaagtatgacggggttacagttccggaattgctcccccgcctttgtgctttcccgctacggagagcggggctaccgttcagataaactatcctgtaaaattcctatcataaaacttcccctctgctgaaagtggggttatcttaaatgaattaattattgctcatgccgcgccaaaaagcggtcccgcaggagacgcaaaccgactccccagcgaagaaaaggttgtggaggaagcagcattggttttgagttagtttggatcaacgcaattgagtcggtcatgtttccgctggcaaggttggcaatttcggttccgaataaaacggccaaaccaattccgctggcattataacagcctgcagcgtacataccgtattctacttctgtaaacacatgcgcgttatttccgcttatacaaatcgtacccgaccaggtggattcaaacaaatcaccaccaagacggggaaaacgccgtttcagtccctctaaatgtttcgctttacgggtctttaaatcggtgaatttcatatttattgccggccatgcttcaacagtgttacgcattaaaatccgtcgatcttttgttaaacggacagtggctcccattgattgaacggacaacactccccatggagccggccggccaatagattcatcttctttttcggtcaatgggcgagtcatgctggcagtcagcgtgagggggaatgtccgattcgattttacgccacaactggccataaaactattcaccgtcacaatcagtttttgacaggtcacctgccccgagggcgtatacaattggtagccttcagtatggctccgttttcgccaatttaagaccggagcattttcatacaactccacttgttccggtaaattttctaccataccacgtgcgagtttggctggctgcagcaatatgccgccctccgtccataagcccatgcagtaataagaactgccgagtcgctgatgcagttcttcaccttcaagaattttatgtttcagttccagctctgacaacaacttgctgaaattcagcagttttttctcatggtccttaactgctgtagcatgaattttnccatttgcttccagatcgcagtcaatgtccagttcagctaccagncgctgaactgcttccactccggcatgtttgatatcatactttttccgatactcctcaagattggatgcagaaaaatgaccttcatttagaatcgaatccactagaaatccggaattcctggcacttgaaccttcgcctgcgttttggccttctaaaagaattatgcgtgactgaggatgcaaaatcgacaattgccgagccgcggcaagtcctgtgtaacccgcaccaagcacaacccaatccgcatgctgttcaccggaaagataaggccgactctggcgagacggcagttgtttaatccaaccgcaactgttgtcgttttttggtngtgtagaaatgatcttagccgccattgtgattttattttcttagtaagatgaaaactctaattgaggtattgngnaatacagttcaggaaattcttggccgcaaatgtgcgtaccagtgtttttcaacccacttgaaaaaccagacaatacaaaaagtgcagcacagatagaagaaccctgctgtgatgaacgactcaaaaggtacaaaatatcgggcattcactatttttgctgcaccaaacagatctacaatcgtaatcactcccgcaagagcactgccatgcagcataaaaatcacttcattgccgtaagcaggtaaagcacgccggaaggaaccgggaaggataatgcggcgntacatcgtgcttttngacatgccgcaagcctgggctgcttcngtttcnccgaatggngtttgttcaattgcaccccgtaatatttctgcagtgtaccccgcagtattcagggcaaaagctgtaatggcacaccaatatgcttccttgaaaagtatccagagcacgctttcacgaactgcttcaaactggcccatgccgtaatagagcaagaanatctgcaccaataacggtgttccccgaaagaaataaatataagtctttgcaggaaatctcaataatgaggtttttgaaacngccatcaaggctaaaggaactgctaatccaaatcctgaaacnaaggcgatcacgaccaactggattgtaacccaaagcccattcaaataaagcgggagattgtcaataatnacattataatccatgattcaaaccntncgtaccccaacactataacggcgattggcccaacgtaaaccaaggtcagatagcccggtaatgcacaaaaacaacagngcaacnaccaggnaaaangtaaaaggctggcgagtggcccctccagcaacacctgcattgtacatcatgtcgtgcaatccaatcactgaaacgagagcagtcgttttggccagaaccatccagttatttccnaatccnggcanagcgtggcgcaccatcagtggtaatgtaatgcgtaaaaatactttccagcttggcattccaaaggcaagagccgcttcaatttctccangggacacngccangatnccaccgcgaaangtttcggtcatgtatgctccaaaaataaaacctattgtgagggttccggcaacaaaagggctgatgtctatgtagtcccaanccagtgagtctccaatattgttgacaatgatttgnccaccatagaaaataatggtcatcagtaccaaatcaggaattccgcggatcagagtggtatanacagttgcngtgcttcgggctatcctggatttngagagcttggctatagctccaaataaaccaagaatgacagcaattaaaagggaaagtaaggcgacttctatggttagcgtcattccttccagaatcatcgggaaatagccatgtaaatcaaacattcctgaataatgtgagggaaaaaagggaaggccacggaatcctcgaattccgtggcaaaataagagaaaaattctnactttttagaggcntccncngagtattatgntaaacctcagccaagataaatcttagtaaacgtcaaaggcaaaatatttgccgttaatcatatgataaacaccnttagagcgaatnaccttaatngctaaactgaaaagt

SEQ ID NO: 1618 - DNA, 4000 bp, Escherichia coli
  misc_feature (140)..(140): n is a, c, g, or t
  misc_feature (294)..(294): n is a, c, g, or t
  misc_feature (364)..(364): n is a, c, g, or t
  misc_feature (471)..(471): n is a, c, g, or t
  misc_feature (1877)..(1877): n is a, c, g, or t
  misc_feature (3468)..(3468): n is a, c, g, or t
  misc_feature (3711)..(3711): n is a, c, g, or t
tacagattcctcccggcgaggtctgccctgcaatcgtaagattgtcattttttgttttaagttcacgttccagcatgatagtaccggaaattgcaaaaacaacagttcgtgcaccgcttttctctactgcatatcgtaangttccttccggcttgctggcagggtcatccaaacgtgtcacaacatatacagcacctccgcggccaccggtcgcattgcgaccatgaccttcagcataaggaaaagcaaataactcgccatagtccaatgttttcactccggtatcaggagagncgttttcctcaccattgctttcatcgtcgccgttgctacctatatttccttccgaatctacaatcggatnatctccggaacaggaaataaccccgaatcccaaaacaaatagcaaatagaacaaccaatatatacctttcatatcttatccgttttttaatccaaatatgtaattanacaaatatcatttagccggataaagtttctctaccaagctattgatatatacttccaaatttgtatattccttactcagattatatttgactccatctgcagaacttttcggattcagcccattggctgcctcccaagcatccggcattccgtcgccgtctgtatccacaggggcattctctttcacatatacaggccatcctcccacatccgttgccttatcaataagtcccagcacactgccgttacttcctgaggccgtataatctccattacgtacattgtctactatacgcctgtccaccgcatcagacttcaacgaagcaccggcatacagcagtacggctttataagcttctgaagcagactgcgtaaataatgccgcatcatcggttattgtaaattccgagttagcctgaatagcagactttccaccggaaggtaagagtacaccggatgtctcattcggctgcaaaccgacccaattatcattgttcacctcctccagcaaagactgataagcaggatttaattgagggcatgtaccatcaaaatagttaccattcagataaaacattccccatgttccttttgcatttttattttttccatcatctccattcggctgaaaaatgcgattgacaatatttggtttttcattggtagaaggccccggtttataataattattcacaaaattataacttcctccttcaccggcatagccgccattggtaggtccccaattataaaagacattgttgcgtaaatctactttttcattgccgggtttaccggtatacctactgccacatagacgaggagtacgactactatgatgtgccagaagattatggtggaacgtagcaggtgagccaccccaaatacctccatacccatgattacctttggtatgtacagaacggttcaaactctcgctgataatacaccactgcatagtaaaattgctattatcataaaaggaagcacactcatccgtacaccagctcatggaacaatgatctatgatgatgttcttatgttgctttccccaaagtgcatcgccactatccgcctcaccttcagttgtgaaattatcagatcccattcgaaaacgcataaaacgaataatgacattatcagcctgtacagaaaccggataacctttcaaacaaataccgtctccgggagctgtctgaccggcaattgtcaggtcaccatttactattttcagcgggctgttcaaatctatcagtccactcactgcaaacacaatcgtacgcgctccgctttggctgataccgtaacgcaaagtccctttttcgttggtgtctgccaatgaagtcaccacatacacctttccacctgctccgcctgtagtaaaccgaccggcgccatatgcaccnggaaatgcagcaatcgaagaacggtccggagcaggatactcttccaatgtattatccgtatccggattattatctccatccccattattatcagtttctggcggaacttccgttccgccagaaaccggattatcatccgaacatgccactactgaagcagaaaggatgaaacacagcaaaccaaaataaacgagtttcaatattctcataagtaagttttttaatacataaaagccggcagcagatttaccggcttttataaaacaattattcagcactgatgcttccgtagtgtcctactcccctgactgtgtataccccgtcagcagcagtcgtaacagataccgaagtttcggtagtctgtgccaaatagacgccattcacaaaaataagataacctgcagctccgtctattgcattccaacttaaagtagtaccatccaaggtagccatagtagtgcctggggtctgcatatactgtttcggattccatccctctctggcaatgatgttctcataagtatatccggcagcttcatctgcagaaagaacttttgcagtaaactgactgctgccgctaccaactgtcatatctcctgttgaaattacctgattatttttatcaaccgtattatattcgccaaaaagagcaggcgctgcgctacccgcagtccaatgaccgtctataatatccatcttcaaagcagtgttaatgaaaaccgccttcgcagaagttgattgctgacgtccgaaagaaaaagcggttatacctgcctcaccgtctatcgtacagtctttcatcacatacccataagcatcggtttcgttactacgtgaagccgtaataaaactaccattgcccgtgttataaaaagtactgttttctatcagcacatcaccacttccccagatatagtccgtactaccttcaatccatgaattttgtacataagcccggcaaataccatacgttccgttcactttctggaaacgcgtccaccacgtatcctggaatgaaaccaatttacaattattcatagccaatctatcataatggctacacagagcttcagcttgtccaccttttccaagaccaccgtcatagcggcttttcaatgcaccgtacaagttaataatggaaatgttctccaggtaaacatcagtggctttaatcaatactacacaattctgatctgtggtatatcctgcaaggcgcgcaggtgaattaggattgtgaatagaataaggccatgtatccgaattagtttgctcctctacacgattcaacgcaaattgaattttcactctgtcaggattttctccaatcaaatgaataaacggttttgttttaggtatatatacacattcattataggttcctgctgcaataaaaatcaggtaaggcgatgtcaaattggcaggagcggcattaatagcagcttgtacagtggtataatcacctcttccgtttgcatcaacaacagcatcaaacaccgtttcgctatctccaccggaaataccggaagtggctgtaaacttcaaagtaatatctttgctgtaaggacgatgctgcatatccgtcaatgtaccngcctcgataaataaggaacattcggaaccttcactgacagaataaggatagcggactttctcataattgatgacaatctgattggaagcaaccttatcattgaaataaattccggttgtcagcacttcaccggtttcttcatccttagtcggcggagtctggcgcatggctttgctaaagacaaactccacataaccatcagtacccgccgtcaaattgttctccgtttccgaatcaatattngcaagatcaacctccgtaccattgatattgcatgaaataagaacaggagcacttgtattttccttgccttcatcgttatcttcacaggcataacctgtgaagataagtaacaagaggagcaagcatttgcctactgtataaatagattttgtattcatattagttcatgttattaaatttattatttattccaacgcggatcaccgattatcttaacttcattcggaatatctgcaccgaaagtcaaatcaagcacatcggtacttgaagatgcattcgggaacagttg

SEQ ID NO: 1619 - DNA, 4000 bp, Escherichia coli
  misc_feature (1)..(2): n is a, c, g, or t
  misc_feature (4)..(5): n is a, c, g, or t
  misc_feature (7)..(8): n is a, c, g, or t
  misc_feature (12)..(12): n is a, c, g, or t
  misc_feature (14)..(15): n is a, c, g, or t
  misc_feature (17)..(18): n is a, c, g, or t
  misc_feature (21)..(21): n is a, c, g, or t
  misc_feature (23)..(24): n is a, c, g, or t
  misc_feature (26)..(27): n is a, c, g, or t
  misc_feature (29)..(29): n is a, c, g, or t
  misc_feature (31)..(31): n is a, c, g, or t
  misc_feature (35)..(35): n is a, c, g, or t
  misc_feature (38)..(39): n is a, c, g, or t
  misc_feature (41)..(43): n is a, c, g, or t
  misc_feature (45)..(45): n is a, c, g, or t
  misc_feature (47)..(47): n is a, c, g, or t
  misc_feature (49)..(55): n is a, c, g, or t
  misc_feature (58)..(60): n is a, c, g, or t
  misc_feature (62)..(62): n is a, c, g, or t
  misc_feature (64)..(69): n is a, c, g, or t
  misc_feature (71)..(71): n is a, c, g, or t
  misc_feature (73)..(73): n is a, c, g, or t
  misc_feature (77)..(77): n is a, c, g, or t
  misc_feature (80)..(81): n is a, c, g, or t
  misc_feature (83)..(83): n is a, c, g, or t
  misc_feature (86)..(86): n is a, c, g, or t
  misc_feature (88)..(89): n is a, c, g, or t
  misc_feature (92)..(93): n is a, c, g, or t
  misc_feature (95)..(98): n is a, c, g, or t
  misc_feature (100)..(100): n is a, c, g, or t
  misc_feature (102)..(106): n is a, c, g, or t
  misc_feature (108)..(108): n is a, c, g, or t
  misc_feature (110)..(110): n is a, c, g, or t
  misc_feature (112)..(117): n is a, c, g, or t
  misc_feature (119)..(123): n is a, c, g, or t
  misc_feature (125)..(126): n is a, c, g, or t
  misc_feature (128)..(130): n is a, c, g, or t
  misc_feature (134)..(134): n is a, c, g, or t
  misc_feature (137)..(137): n is a, c, g, or t
  misc_feature (140)..(141): n is a, c, g, or t
  misc_feature (144)..(145): n is a, c, g, or t
  misc_feature (147)..(147): n is a, c, g, or t
  misc_feature (149)..(151): n is a, c, g, or t
  misc_feature (153)..(156): n is a, c, g, or t
  misc_feature (159)..(159): n is a, c, g, or t
  misc_feature (162)..(162): n is a, c, g, or t
  misc_feature (164)..(166): n is a, c, g, or t
  misc_feature (168)..(169): n is a, c, g, or t
  misc_feature (171)..(172): n is a, c, g, or t
  misc_feature (174)..(174): n is a, c, g, or t
  misc_feature (178)..(179): n is a, c, g, or t
  misc_feature (182)..(182): n is a, c, g, or t
  misc_feature (184)..(184): n is a, c, g, or t
  misc_feature (186)..(186): n is a, c, g, or t
  misc_feature (188)..(188): n is a, c, g, or t
  misc_feature (192)..(196): n is a, c, g, or t
  misc_feature (198)..(199): n is a, c, g, or t
  misc_feature (202)..(202): n is a, c, g, or t
  misc_feature (204)..(205): n is a, c, g, or t
  misc_feature (209)..(209): n is a, c, g, or t
  misc_feature (211)..(211): n is a, c, g, or t
  misc_feature (217)..(218): n is a, c, g, or t
  misc_feature (220)..(224): n is a, c, g, or t
  misc_feature (226)..(227): n is a, c, g, or t
  misc_feature (232)..(236): n is a, c, g, or t
  misc_feature (238)..(239): n is a, c, g, or t
  misc_feature (241)..(242): n is a, c, g, or t
  misc_feature (249)..(249): n is a, c, g, or t
  misc_feature (252)..(252): n is a, c, g, or t
  misc_feature (258)..(258): n is a, c, g, or t
  misc_feature (263)..(267): n is a, c, g, or t
  misc_feature (270)..(270): n is a, c, g, or t
  misc_feature (273)..(273): n is a, c, g, or t
  misc_feature (275)..(275): n is a, c, g, or t
  misc_feature (284)..(285): n is a, c, g, or t
  misc_feature (287)..(288): n is a, c, g, or t
  misc_feature (290)..(290): n is a, c, g, or t
  misc_feature (292)..(292): n is a, c, g, or t
  misc_feature (294)..(294): n is a, c, g, or t
  misc_feature (297)..(297): n is a, c, g, or t
  misc_feature (299)..(299): n is a, c, g, or t
  misc_feature (307)..(307): n is a, c, g, or t
  misc_feature (311)..(313): n is a, c, g, or t
  misc_feature (321)..(321): n is a, c, g, or t
  misc_feature (323)..(323): n is a, c, g, or t
  misc_feature (325)..(325): n is a, c, g, or t
  misc_feature (334)..(335): n is a, c, g, or t
  misc_feature (339)..(339): n is a, c, g, or t
  misc_feature (341)..(341): n is a, c, g, or t
  misc_feature (343)..(345): n is a, c, g, or t
  misc_feature (347)..(347): n is a, c, g, or t
  misc_feature (355)..(356): n is a, c, g, or t
  misc_feature (358)..(360): n is a, c, g, or t
  misc_feature (364)..(364): n is a, c, g, or t
  misc_feature (373)..(374): n is a, c, g, or t
  misc_feature (376)..(376): n is a, c, g, or t
  misc_feature (380)..(380): n is a, c, g, or t
  misc_feature (383)..(384): n is a, c, g, or t
  misc_feature (386)..(386): n is a, c, g, or t
  misc_feature (388)..(394): n is a, c, g, or t
  misc_feature (400)..(400): n is a, c, g, or t
  misc_feature (407)..(407): n is a, c, g, or t
  misc_feature (409)..(410): n is a, c, g, or t
  misc_feature (416)..(417): n is a, c, g, or t
  misc_feature (420)..(421): n is a, c, g, or t
  misc_feature (425)..(427): n is a, c, g, or t
  misc_feature (433)..(435): n is a, c, g, or t
  misc_feature (438)..(438): n is a, c, g, or t
  misc_feature (441)..(442): n is a, c, g, or t
  misc_feature (444)..(444): n is a, c, g, or t
  misc_feature (447)..(448): n is a, c, g, or t
  misc_feature (450)..(450): n is a, c, g, or t
  misc_feature (453)..(453): n is a, c, g, or t
  misc_feature (456)..(457): n is a, c, g, or t
  misc_feature (460)..(461): n is a, c, g, or t
  misc_feature (465)..(465): n is a, c, g, or t
  misc_feature (467)..(469): n is a, c, g, or t
  misc_feature (471)..(471): n is a, c, g, or t
  misc_feature (473)..(473): n is a, c, g, or t
  misc_feature (475)..(478): n is a, c, g, or t
  misc_feature (482)..(484): n is a, c, g, or t
  misc_feature (486)..(486): n is a, c, g, or t
  misc_feature (489)..(491): n is a, c, g, or t
  misc_feature (493)..(495): n is a, c, g, or t
  misc_feature (497)..(497): n is a, c, g, or t
  misc_feature (500)..(500): n is a, c, g, or t
  misc_feature (502)..(503): n is a, c, g, or t
  misc_feature (507)..(507): n is a, c, g, or t
  misc_feature (512)..(512): n is a, c, g, or t
  misc_feature (515)..(517): n is a, c, g, or t
  misc_feature (522)..(522): n is a, c, g, or t
  misc_feature (533)..(533): n is a, c, g, or t
  misc_feature (539)..(539): n is a, c, g, or t
  misc_feature (541)..(541): n is a, c, g, or t
  misc_feature (550)..(550): n is a, c, g, or t
  misc_feature (603)..(603): n is a, c, g, or t
  misc_feature (610)..(611): n is a, c, g, or t
  misc_feature (704)..(704): n is a, c, g, or t
  misc_feature (761)..(761): n is a, c, g, or t
  misc_feature (1430)..(1430): n is a, c, g, or t
  misc_feature (2014)..(2014): n is a, c, g, or t
  misc_feature (2028)..(2028): n is a, c, g, or t
  misc_feature (2048)..(2048): n is a, c, g, or t
  misc_feature (2183)..(2183): n is a, c, g, or t
  misc_feature (2367)..(2367): n is a, c, g, or t
  misc_feature (2430)..(2430): n is a, c, g, or t
  misc_feature (2517)..(2518): n is a, c, g, or t
  misc_feature (2784)..(2784): n is a, c, g, or t
  misc_feature (3495)..(3495): n is a, c, g, or t
  misc_feature (3498)..(3498): n is a, c, g, or t
  misc_feature (3501)..(3502): n is a, c, g, or t
  misc_feature (3504)..(3504): n is a, c, g, or t
  misc_feature (3729)..(3731): n is a, c, g, or t
  misc_feature (3734)..(3734): n is a, c, g, or t
  misc_feature (3739)..(3741): n is a, c, g, or t
  misc_feature (3748)..(3750): n is a, c, g, or t
  misc_feature (3753)..(3755): n is a, c, g, or t
  misc_feature (3757)..(3757): n is a, c, g, or t
  misc_feature (3759)..(3759): n is a, c, g, or t
  misc_feature (3761)..(3763): n is a, c, g, or t
  misc_feature (3766)..(3768): n is a, c, g, or t
  misc_feature (3770)..(3773): n is a, c, g, or t
  misc_feature (3775)..(3786): n is a, c, g, or t
  misc_feature (3788)..(3789): n is a, c, g, or t
  misc_feature (3792)..(3794): n is a, c, g, or t
  misc_feature (3797)..(3797): n is a, c, g, or t
  misc_feature (3799)..(3799): n is a, c, g, or t
  misc_feature (3802)..(3803): n is a, c, g, or t
  misc_feature (3805)..(3805): n is a, c, g, or t
  misc_feature (3807)..(3808): n is a, c, g, or t
  misc_feature (3810)..(3814): n is a, c, g, or t
  misc_feature (3816)..(3818): n is a, c, g, or t
  misc_feature (3821)..(3824): n is a, c, g, or t
  misc_feature (3826)..(3826): n is a, c, g, or t
  misc_feature (3830)..(3837): n is a, c, g, or t
  misc_feature (3840)..(3841): n is a, c, g, or t
  misc_feature (3843)..(3850): n is a, c, g, or t
  misc_feature (3852)..(3852): n is a, c, g, or t
  misc_feature (3854)..(3854): n is a, c, g, or t
  misc_feature (3856)..(3864): n is a, c, g, or t
  misc_feature (3866)..(3866): n is a, c, g, or t
  misc_feature (3868)..(3883): n is a, c, g, or t
  misc_feature (3885)..(3887): n is a, c, g, or t
  misc_feature (3890)..(3892): n is a, c, g, or t
  misc_feature (3897)..(3909): n is a, c, g, or t
  misc_feature (3911)..(3921): n is a, c, g, or t
  misc_feature (3924)..(3927): n is a, c, g, or t
  misc_feature (3929)..(3934): n is a, c, g, or t
  misc_feature (3937)..(3938): n is a, c, g, or t
  misc_feature (3940)..(3940): n is a, c, g, or t
  misc_feature (3942)..(3949): n is a, c, g, or t
  misc_feature (3951)..(3957): n is a, c, g, or t
  misc_feature (3959)..(3968): n is a, c, g, or t
  misc_feature (3970)..(3974): n is a, c, g, or t
  misc_feature (3976)..(3976): n is a, c, g, or t
  misc_feature (3978)..(3983): n is a, c, g, or t
  misc_feature (3985)..(3998): n is a, c, g, or t
  misc_feature (4000)..(4000): n is a, c, g, or t
nntnncnnggcncnncnnggncnntnncnanggcnccnncnnngncngnnnnnnncannncngnnnnnngngnggcngcnncnacngnntcnncnnnnangnnnnngncngnnnnnncnnnnncnntnnngccngcnacnncgnngncnnngnnnncgntgncnnngnngnngntggnngcngngncngtgnnnnngnnggncnnggcngngctggnncnnnnngnnctggnnnnngnngnnccagccncgncagccngggcnnnnngcnccncncgcaaagcnngnncncncngcncncgttgcanagcnnnggcagctncngnccctagtanngccncnannntntccactcnncnnnctgnttgggccanntnagcncgnngnannnnnnnttgctnagcggtnanncggggnnctnnaggnnntgaggnnnctnagnntnccnnanccnccnnggnnactngnnnancngnnnnagcnnntntannngnnncngantnnaccncttgngcnnncggcncgccggctggngcgccngncgctggtgngccttggcttggcgcagctgacacgccttgagctgatgcacctgccactgcgncagctgnngcgcctggcgctacggcgactggctggccttgaactgcggcagctggttggccggccgcgcccagaggcggcagggcgtcggtgaggaaatgntcaatgcgtcggcttggggcagccgaggggaaagtaaccccctgcccaagctgacgncctaccccaatacgggccagggcgacgtcgtccatgttcatatccccacccaaaatatgggccccaggcaaaccagccagcttccaccaggcgtgggccagctggcgccgggcggtggtggggtgggtggccaggtgcacgctagccacgttaagcggcacctgcccgacgccgtcgaccaaagtagccgccagcatcaggcgcgttgaagcggtaaacagcgcatagggcagcttgccaccctcgcggcgcacaatcgtgggcacgccccgccccagccgctccacacgccaagtttgcaccggtaggcgcgacaaaatggcgttaccaaaaccgcgcagaggggccagtggctccaacactcgcagcgggtcgtcaccaaaggtgcgcacctggctgcggcgtgggcggtgacgcaggcggtctactcccccagcgtaggtggcggcaaaacgccaatgcgggtaaccggcctgctcagctagcaaacccgccaaatccacccggcctgagcggttttggtgcaaatccacttcctgcagcaaaaccacgtcagcgttcagctcacgcagctgctgggccacctgactgtaaagctggtgagcaacttgagggctgtagggctgaccagaagccacctcggctagcgtggcagtgtcattggcccgnccgtactggaggtttgcgctggccaggcgtagttttgtgatcactctttaggctcgttagttgcgaaacttagcgccaccgagttcatgcagtaacgctgaccggtgggggtggcgggggcgtcgtcgaaaacgtggcccaggtgggagccgcagttagcgcagcgcacctcggtacgctcataacccagcttgtaatctgagtgcagcgtcaccgcatcggtttccttggggtcatagaaggacggccagccacagcccgactcgaacttggtggtggatttaaacagctgcgccccgcaggcccggcaagagtagatgccttcacggttttcgctcagcagctcgccggtgaaaggcatttcggtgccagcctgacgcagcacctcatactcagccgggtttaggcgctcacgccactgggcgtcagtgagctgcgcaaactcttgattctcactcatgactcatccttggttttatccgacacggcaggtagtacagcggttttatccacttcatttattcccgcctcggcgtcaggggcctgggtggagatggcgtcaggggcctgggtggagatggcgncaggggcctgggtnaccttagcggcagccccagntgagccagcagcgacggcgtcgggggccgcaccagagcgtcctacctcagccgcaccagagcgaagggcctctaccttggccttagcgctacggctagccgcgctgagcacaccgcgtgcctgctccgggcgcanctgccgctttgcctcctcaatcgcagaaatctgggctacctgcgtggggtcagagagcaccatggtggccggctcaggtgcgttagttgcttccgacccggtttgcacgcccggcaacagtccacggcgcaaaatccgacgccgccgcatcttcttggagcgcactgcggccgcctgcacccgngcttcctcaatgggatcgccctgctcagctttagttactgccggctgggacttggtgtcactngatagctgcgccaattcctgggctagcttagccaccttttcaggggtgggatcttgcatgacggtaacgttttccacctccacacgnngacgcggcagggcatagggggcttctttttgcagccaagtcaccatttcttcacgcacatggcattgcagtttgaaggcatcaacactgtttgctgccgaaacagttaggcgcacccggatcaaagagttttgggcatcaattactgatagcgctgcgtcacgcccatcccaggtggatgaggaggccacaaacttagctagctgcgcccgcatagcggcgataggtgcacgccaatccaggtcaaaattgatttgtgcagtctgncgttcatcacgacgcgaccagttagtaaaagggttctctgtgaagtatttgctgggcagcaagatacggcgcccgtcagcggccaaaaccaccacataggtgaacgtgatttcttcgattcggccagagtcagtggcattaataaccacctggtcatccacacggatagcgtcagtgatggccagctgcacacctgcaaacaggtttcccagcactgattgtgcagccaaaccggctaccaccgaaaccagaccggcactagcaagcagcgaccccatagccaggcgtgcttgtgggaaagtcatgacgatggtgattgcaccaataatgatgacgataacttcagctactcgccgcagaatctgggcctgggtggtgatcttattggcccggcgcacattggtgggatcattgcgcgattcggcatgggccaccacggtagccgaaatggctttaacccagcttacgcacacccaggtcagggccgctttaaacaggattaccagcaacaaaatagcgtagcgataccaggccggggaggaagtgccctccatggccagttgggcgccgattagcgcgccaacaatggcaaacagtgcgtagaaagagttacgccccttgtcccccacgtggtgccacagcagggagcggcgtccggccacatgcactgcaataactacagctaaagccagcaccaggccgattgatagnccnagnncngtgcgccacagcaggctgaaagtgtctaaggtgaccgctgcggcagattctgtgggcgatggcgtggggataggagtcgccaccgcgagtatgtgcccctgatttaacatggcagccacactagtagcgcaggctgtgcgcaagctgtggttttacccgcgcgtccgtataggtaaggcagtccacaaagcttgaggttgcaacataaaactcactgttcacagnnnccncagannncccaaannnggnnncntnannnccnnntnnnnannnnnnnnnnnncnnccnnnccncnctnncngnngnnnnnannnccnnnncnaacnnnnnnnnccnncnnnnnnnncncngnnnnnnnnncncnnnnnnnnnnnnnnnnannnaannnccccnnnnnnnnnnnnnannnnnnnnnnnttnnnngnnnnnnccnncngnnnnnnnncnnnnnnncnnnnnnnnnncnnnnnancnnnnnncnnnnnnnnnnnnnnan

SEQ ID NO: 1620 - DNA, 4000 bp, Escherichia coli
  misc_feature (2010)..(2010): n is a, c, g, or t
  misc_feature (3024)..(3024): n is a, c, g, or t
  misc_feature (3279)..(3279): n is a, c, g, or t
  misc_feature (3285)..(3285): n is a, c, g, or t
  misc_feature (3287)..(3287): n is a, c, g, or t
  misc_feature (3289)..(3289): n is a, c, g, or t
  misc_feature (3291)..(3291): n is a, c, g, or t
  misc_feature (3294)..(3296): n is a, c, g, or t
  misc_feature (3299)..(3299): n is a, c, g, or t
  misc_feature (3302)..(3302): n is a, c, g, or t
  misc_feature (3304)..(3304): n is a, c, g, or t
  misc_feature (3307)..(3307): n is a, c, g, or t
  misc_feature (3309)..(3326): n is a, c, g, or t
  misc_feature (3328)..(3328): n is a, c, g, or t
  misc_feature (3331)..(3331): n is a, c, g, or t
  misc_feature (3334)..(3334): n is a, c, g, or t
  misc_feature (3337)..(3337): n is a, c, g, or t
  misc_feature (3339)..(3343): n is a, c, g, or t
  misc_feature (3346)..(3350): n is a, c, g, or t
  misc_feature (3355)..(3357): n is a, c, g, or t
  misc_feature (3359)..(3361): n is a, c, g, or t
  misc_feature (3365)..(3365): n is a, c, g, or t
  misc_feature (3367)..(3377): n is a, c, g, or t
  misc_feature (3379)..(3386): n is a, c, g, or t
  misc_feature (3389)..(3389): n is a, c, g, or t
  misc_feature (3391)..(3391): n is a, c, g, or t
  misc_feature (3393)..(3402): n is a, c, g, or t
  misc_feature (3407)..(3407): n is a, c, g, or t
  misc_feature (3409)..(3413): n is a, c, g, or t
  misc_feature (3418)..(3418): n is a, c, g, or t
  misc_feature (3420)..(3425): n is a, c, g, or t
  misc_feature (3427)..(3427): n is a, c, g, or t
  misc_feature (3430)..(3430): n is a, c, g, or t
  misc_feature (3432)..(3433): n is a, c, g, or t
  misc_feature (3436)..(3436): n is a, c, g, or t
  misc_feature (3438)..(3451): n is a, c, g, or t
  misc_feature (3454)..(3458): n is a, c, g, or t
  misc_feature (3461)..(3461): n is a, c, g, or t
  misc_feature (3472)..(3473): n is a, c, g, or t
  misc_feature (3479)..(3480): n is a, c, g, or t
  misc_feature (3482)..(3485): n is a, c, g, or t
  misc_feature (3487)..(3488): n is a, c, g, or t
  misc_feature (3490)..(3492): n is a, c, g, or t
  misc_feature (3499)..(3501): n is a, c, g, or t
  misc_feature (3504)..(3504): n is a, c, g, or t
  misc_feature (3506)..(3506): n is a, c, g, or t
  misc_feature (3508)..(3508): n is a, c, g, or t
  misc_feature (3512)..(3520): n is a, c, g, or t
  misc_feature (3522)..(3527): n is a, c, g, or t
  misc_feature (3529)..(3530): n is a, c, g, or t
  misc_feature (3532)..(3532): n is a, c, g, or t
  misc_feature (3535)..(3535): n is a, c, g, or t
  misc_feature (3538)..(3538): n is a, c, g, or t
  misc_feature (3540)..(3540): n is a, c, g, or t
  misc_feature (3544)..(3545): n is a, c, g, or t
  misc_feature (3549)..(3550): n is a, c, g, or t
  misc_feature (3553)..(3553): n is a, c, g, or t
  misc_feature (3559)..(3559): n is a, c, g, or t
  misc_feature (3562)..(3562): n is a, c, g, or t
  misc_feature (3565)..(3565): n is a, c, g, or t
  misc_feature (3568)..(3568): n is a, c, g, or t
  misc_feature (3571)..(3571): n is a, c, g, or t
  misc_feature (3573)..(3574): n is a, c, g, or t
  misc_feature (3576)..(3577): n is a, c, g, or t
  misc_feature (3579)..(3584): n is a, c, g, or t
  misc_feature (3586)..(3587): n is a, c, g, or t
  misc_feature (3589)..(3589): n is a, c, g, or t
  misc_feature (3591)..(3600): n is a, c, g, or t
  misc_feature (3602)..(3603): n is a, c, g, or t
  misc_feature (3605)..(3609): n is a, c, g, or t
  misc_feature (3612)..(3612): n is a, c, g, or t
  misc_feature (3615)..(3615): n is a, c, g, or t
  misc_feature (3618)..(3618): n is a, c, g, or t
  misc_feature (3623)..(3623): n is a, c, g, or t
  misc_feature (3626)..(3629): n is a, c, g, or t
  misc_feature (3631)..(3631): n is a, c, g, or t
  misc_feature (3634)..(3634): n is a, c, g, or t
  misc_feature (3638)..(3638): n is a, c, g, or t
  misc_feature (3641)..(3641): n is a, c, g, or t
  misc_feature (3643)..(3647): n is a, c, g, or t
  misc_feature (3654)..(3655): n is a, c, g, or t
  misc_feature (3657)..(3664): n is a, c, g, or t
  misc_feature (3666)..(3667): n is a, c, g, or t
  misc_feature (3669)..(3672): n is a, c, g, or t
  misc_feature (3674)..(3674): n is a, c, g, or t
  misc_feature (3677)..(3678): n is a, c, g, or t
  misc_feature (3681)..(3682): n is a, c, g, or t
  misc_feature (3684)..(3687): n is a, c, g, or t
  misc_feature (3691)..(3691): n is a, c, g, or t
  misc_feature (3694)..(3694): n is a, c, g, or t
  misc_feature (3697)..(3697): n is a, c, g, or t
  misc_feature (3700)..(3701): n is a, c, g, or t
  misc_feature (3704)..(3704): n is a, c, g, or t
  misc_feature (3706)..(3707): n is a, c, g, or t
  misc_feature (3709)..(3710): n is a, c, g, or t
  misc_feature (3712)..(3712): n is a, c, g, or t
  misc_feature (3715)..(3716): n is a, c, g, or t
  misc_feature (3719)..(3720): n is a, c, g, or t
  misc_feature (3722)..(3730): n is a, c, g, or t
  misc_feature (3732)..(3732): n is a, c, g, or t
  misc_feature (3734)..(3734): n is a, c, g, or t
  misc_feature (3737)..(3742): n is a, c, g, or t
  misc_feature (3745)..(3746): n is a, c, g, or t
  misc_feature (3748)..(3749): n is a, c, g, or t
  misc_feature (3751)..(3752): n is a, c, g, or t
  misc_feature (3754)..(3755): n is a, c, g, or t
  misc_feature (3757)..(3758): n is a, c, g, or t
  misc_feature (3760)..(3761): n is a, c, g, or t
  misc_feature (3763)..(3763): n is a, c, g, or t
  misc_feature (3765)..(3765): n is a, c, g, or t
  misc_feature (3768)..(3770): n is a, c, g, or t
  misc_feature (3772)..(3775): n is a, c, g, or t
  misc_feature (3777)..(3784): n is a, c, g, or t
  misc_feature (3786)..(3790): n is a, c, g, or t
  misc_feature (3792)..(3793): n is a, c, g, or t
  misc_feature (3795)..(3796): n is a, c, g, or t
  misc_feature (3798)..(3799): n is a, c, g, or t
  misc_feature (3801)..(3802): n is a, c, g, or t
  misc_feature (3804)..(3805): n is a, c, g, or t
  misc_feature (3807)..(3809): n is a, c, g, or t
  misc_feature (3813)..(3813): n is a, c, g, or t
  misc_feature (3816)..(3817): n is a, c, g, or t
  misc_feature (3823)..(3824): n is a, c, g, or t
  misc_feature (3826)..(3827): n is a, c, g, or t
  misc_feature (3829)..(3830): n is a, c, g, or t
  misc_feature (3832)..(3834): n is a, c, g, or t
  misc_feature (3836)..(3836): n is a, c, g, or t
  misc_feature (3838)..(3839): n is a, c, g, or t
  misc_feature (3841)..(3842): n is a, c, g, or t
  misc_feature (3844)..(3844): n is a, c, g, or t
  misc_feature (3848)..(3848): n is a, c, g, or t
  misc_feature (3850)..(3850): n is a, c, g, or t
  misc_feature (3852)..(3858): n is a, c, g, or t
  misc_feature (3861)..(3861): n is a, c, g, or t
  misc_feature (3864)..(3864): n is a, c, g, or t
  misc_feature (3867)..(3868): n is a, c, g, or t
  misc_feature (3870)..(3870): n is a, c, g, or t
  misc_feature (3873)..(3873): n is a, c, g, or t
  misc_feature (3876)..(3877): n is a, c, g, or t
  misc_feature (3879)..(3880): n is a, c, g, or t
  misc_feature (3883)..(3884): n is a, c, g, or t
  misc_feature (3886)..(3886): n is a, c, g, or t
  misc_feature (3888)..(3888): n is a, c, g, or t
  misc_feature (3893)..(3893): n is a, c, g, or t
  misc_feature (3895)..(3895): n is a, c, g, or t
  misc_feature (3897)..(3897): n is a, c, g, or t
  misc_feature (3899)..(3911): n is a, c, g, or t
  misc_feature (3913)..(3917): n is a, c, g, or t
  misc_feature (3919)..(3920): n is a, c, g, or t
  misc_feature (3922)..(3923): n is a, c, g, or t
  misc_feature (3925)..(3925): n is a, c, g, or t
  misc_feature (3928)..(3933): n is a, c, g, or t
  misc_feature (3935)..(3935): n is a, c, g, or t
  misc_feature (3937)..(3937): n is a, c, g, or t
  misc_feature (3939)..(3939): n is a, c, g, or t
  misc_feature (3943)..(3943): n is a, c, g, or t
  misc_feature (3945)..(3946): n is a, c, g, or t
  misc_feature (3962)..(3962): n is a, c, g, or t
  misc_feature (3965)..(3969): n is a, c, g, or t
  misc_feature (3972)..(3976): n is a, c, g, or t
  misc_feature (3978)..(3978): n is a, c, g, or t
  misc_feature (3982)..(3984): n is a, c, g, or t
  misc_feature (3986)..(3989): n is a, c, g, or t
  misc_feature (3994)..(3995): n is a, c, g, or t
  misc_feature (3997)..(3997): n is a, c, g, or t
gcacgcgaacgcttgcgcgacgcgcttgagcgtcgcgcgtcgaccgacggcgagaaagacttcgttttctttgtgtttaccatagtcactcgccgccttgttgaagaggtttttttgttcgacgagttcgcgctcggcgcgggcgaggcgacgtttgagctcgtccgggtcgttcgtcggcgtccgtggacgcgtcggggatccgagctggggcgggggcgacggtggggtggtggtcatcgcggcgcggtgtgaggtttacccaaggcgaagagagagtttgttggtttgttggttgaatgtactactgtaagaatcgctgctatcgggctatcgcgctacggtgagctagttactagtgagaatcgcgggcgtggtgccaccgcgtgtgtcgttttcgtcgtgcgtcagtgttgctccggcgcgaatgcgcgttggatgtgctctagaaggaatttggcggcggctcgattaacgtgggcgttgtgcgcgtcgcaactcagacgttgcacgcaagatggacatccgtcggcacgcgagcacgcgcagtcgtcgacgatggatttcgcacgactgatgagttctggaaagagtttcgacgcgcggctggtgatgccgacgccgccgaggtggcgatcgtaaatgagaaagcgatgcggggcgtatcggcgaccgcgttctgcgtgtaaatcggcggagaagcactcgcaaccgacatcgttttctccgcacggaatgtggagaggtaaggcgttgaggagcgcgtgcgatgcggcgtggacgccggcgcgtaaatcgatgccggcgtcggtcgcgagcgcgcacaccgagtctggtatgcgcaaccacgcgccgacggtgtcgaatcgcgtctcgcgcggcggaaagctttcctggtcgaatttcgcctgcgaaccgcgagcgacgcggctgaaacccgtaaagacggttctgatttccacgtcatcgcacttgacacactgtcgaagcggaagctggctgtcggtctccccgtacgcgcgctgtccgccgggaacaaagcagacggtttcgtgcttcacgcgcgtaaagtacttgacatccgcctgcctcacaaaggcgcgacgacgctccatgtcgagtttttgacacaacagcgttctcccttggtgcgtgtacacggcgccttcgtacacctcgaagaacgctttggaggcttcgatgctagagatgactttaccgaggggctccgccttggtcgccttgctttgatcaaagacttcgtaacgctcctcctcaatcgtccgcactgaaacgtcgagggctggtgttttcgtcgcgcacgccaagagggggtgtgcggtaatatcctcggcgttaccacgcaccaaggcggttgggtccacggcgatgcgacctttgcgaaccatcgactgcgcgacgcctcgagtcaaatcgccaaagtacacttcgtccacgtctccgttcgcgaacaaggggagctcgtacgccgcgcacgcgagatgctgctcgacgatggatggatttctcggatcgacgtaagacatctccaaaggcgcatcaaacagcgctcgaggctgacgcataaagtgttggtcgagaggaccgtcaaaggcgacgtaaatcgacagcgcgtggccttctctgcgcccagctcgaccagcctgctgccataaagacgcgacagatcccggaaatcccaagtgtaaagtcacatcgagcgatccgacgtcaattccgagctcgagggcgttcgtcgtcgccacaccgagtaaagatcccgaaaaaagttccttttcgatgacgcgtcgttcgcccgcttcgtacccgccgcgatacgacgccaccttgtccgccagatgaggcgccgacgagcgcaagatttcgcgcgtgtacacgagcacgagctcgcacaatttcctcgtcttgcaaaacgccaagcaacgcaagttgtgctggacgcactcggctagaatttgtgaaatttccacaaccgggctcgtcctcgcnccgtcctctggtggacgccgcgcgtcaacctctcccggttgtttctccgccgccgtcgtcgtcgtcgtcgcctccccgttccgaagcctttttgccaacgcagctttaccgcgctcgatcggcaactgacgacgaaatttcctctccgtgttcgtctgcgacgtctgccccggtttcagcgtcggattccacaacagaaacgtcttttcgccgcgcggcgccccgtcgttggtcaccacttcaatctcatcttcgctcgcatcgcgcgttcgccaaccgatcaaatccctcgcgtgttccccagggttcgccaccgtcgcgctgctgatgataaactgcgggcacgatccgtaaatctctgcgcaaatccttcgcagtcttcgcacgatgagcgccacgtgcgaaccaaagacgccagagtacgcgtgcgcttcatcgatgacgacgtaacgcaacccagagagaaacttggcccactgcttatgcgccggcatgatgctcacgtgaagcatgtctggattggtgatgatgagtcgcgagttggcgcgcacgtcgacgcgcgcatcctctcgagtatcgccgtcaaagacgccgacgtcaaacacagtttcttcgccacgcggaacgctcgacagaatgttccgtaaagctctcagttgatcttgcgcgagcgcctttgtcggaaacatgtacagcgccgtcgcagtcgggtcaccgagcaacgtctcaatcgtcgggacgttgtagcacacggatttaccgctcgccgtaccggaactcacgatgacgtgtcggcgtcgcgcgttcagtcgctcccccaaaatcgcttcgatcgcgctcgcctggtgactgaagagcgatttcgtcaagtcgatcccaaccccggcaaaggcttgaatcgtggcgtcgctcaaaagcctttggatcttttccggcgaccacgcgacgcgacgcgccgttttcggcgtcatggtttcgacgtgtttgatttgtccgcgcgcgccgagcgtctgngttaaatgttccacaaaggttttcacatccatcggttccgtgctgcgacagtgcccgccggaatccttcgtcgcgtccttcttcgtcgtcgccgtcccggcgtcgccgctttcttcggcgcccgcccgttgtttcctctttgcccgcaatcgcggcggcgctggcggtcgatccatcgcctcgggcggaaccgtcatcgtcgacgagcgatttcgaacgcgcgcgtcgtcgtcgtcgtcgtcgtcgtcgtcgtcntcgtcntncntnttnnncgncgncnccncnnnnnnnnnnnnnnnnnncnccncgncgncnnnnncgnnnnncgtcnnntnnntcgncnnnnnnnnnnngnnnnnnnngangncnnnnnnnnnnccccncnnnnncgccncnnnnnncnccncnnccncnnnnnnnnnnnnnncgnnnnnccncctcgtcgtcnncgtcgnncnnnncnngnnnccgccgnnnctncncnacgnnnnnnnnncnnnnnncnncnccnccncntccnncgcnncgncgacgncgncgnccnccncnncnngnnnnnncnncngnnnnnnnnnngnngnnnnntcntcntcntccgncgnnnngncgncganganannnnncgtcgtnngnnnnnnnngnngnnnngnggnntcnncnnnngganganganganncgncnncnncntcnncgnngnnnnnnnnntncnccnnnnnnacnncnncnncnncnncnncncntcnnncnnnnannnnnnnntnnnnncnncnncnncnncnncnnngccnccnnccaccnncnncnncnnnancnncnncntcgncngnnnnnnntgntgncgnngnaanaannannacnncntngtcgncncntnnnnnnnnnnnnncnnnnncnncnncncgnnnnnnancncnccgncnntcgtcgtcgtcgtcgncgnnnnncgnnnnncntcgnnnannnnctccnncntcg

SEQ ID NO: 1621 - DNA, 4000 bp, Escherichia coli
  misc_feature (576)..(576): n is a, c, g, or t
  misc_feature (612)..(612): n is a, c, g, or t
  misc_feature (1985)..(1985): n is a, c, g, or t
  misc_feature (2015)..(2015): n is a, c, g, or t
ttagatccaaaagatatttatgaagaagacacagacaaaggaaagtttatttttgcaaaaacacaaaaaaaagaaactccagttattgaggaaattaagaaaaatattcctcattttttaaatggcctgcaatggcgaaaaaaaatgcgttggggcaatcatgatctttcttggggcagacctttaaaatcaattttatgtttatttgataaacaaactatttcatttaatttttttcatttaacatcaacaaatgtcacttatgtggatggtccattagatgataaagcagttgttataaaagattatagtcattttaaaaaaatattaactgataaaagaattacctttgataacgcagagagagaaaaattaattactaaaaatattcaatcgtttcttaaaaagaatgattgtgaattagaaattaataataaattacttaagcaagtcattaatcttgttgaggatccaattgttctaaaaggatcatttttaaaagattttttaaaattaccagaagagcttctcattttaacaatgcagcatcatcaaagatatttcccaatgcgctcnactaacaatcataagttaattaataattttattgtngttgcaaataaagaagatattacaaataaaattataaaagggaatgaaagagttcttgccgcacgtttatcagatgcaaaatttttctgggaaaaaaataaaagtcaaaatctagtaaaacaagtaaataaacttaagggaatcactttttatcaaagtcttggttcgcttcatgataaaacgcaaagaataagagttttagcatcattaattgcagattttattaattgtaaaaaagatgatgcagaaatagcagcttcaatttgtaaagcagatttagtttcagatttagtaggagaatatccagagcttcagggtgtgttaggaaagtattttgcagtagagcaaggttttagcttacaaatcgcaaatgcaatctcagatcattatttaccgattggaccagaagatagagtgccaaaagaaaaaatttcaattgcagtcgctctttctgataagattgataatttagttggattcttcggtatcaatgaaaagccaacaagctcaaaagatccttacgcgctaagaagatcagcacttggtattcttagaatattaatagaaaatagaatttctatttcattaaaagagttaattaataactcaaaaaactcatatcttacgcaaagagtgaatatacaaaaccctaagtttgctgaggagattttggttttcatttcagatcgttttaaaaacttacttaaagatcaaaaagttagacctgatgttattgaatctgttttatttaatagtagatccgatgattattattcattgtttactaaaattaaaaatttaaacaaagtagtaaaaagtaatgatgggctaaatgttattgcagtgtacaaaagatgtgcaaatatcttagagcaatcaaaaaaagatcttaaacaagaactttttggagatcccgaaattgttttatttaaacataacgaagagaattttttatttgaaaaaataaatgaaattagagaacattatacaactcctgcacgattacgaacggtagaacagacgatgggtttgctagctggcacaaaaggttttgttgataagttttttgataacgtaaaagttaatgatgaaaacgaacaaattaaaaagaacagattagagttattatttctattgtgtaaaacttttgatagctttgctgacttttcaaaatttgaggtttaaaaatgccaaagtgggtttatcagtttaatagttcaaattgcgaaggaactgtctcgcaaaaacctcttttaggtggaaaaggtgcaaaccttgcggagatgggaaaattaggccttcctgttcctccgggatttacaattacaacagaagtttgcactgagttttataaaaataatcaaaaatatccngccgatcttaaaattcaagtagaagacgcnataaaaaatattgaaaaaattttaggaaaaaattttggcgatgttaacaatcctttattagtatcagttagatcaggcgcaagagtgtctatgcccggaatgatggatactgttttaaatttaggactgaacgacaaaactgttttaggattaattaaaaaaactaataacgaaacatttgcttatgatagctacagacgctttattcaaatgtatagcaacgttgtccttgaagtagatcatcataattttgaggatttgcttgataattataaactaacaaaaggtgtattgtcagacacagatcttaaagctgaagattggaaaacaattgttggcaattataaagatattgtaaagaaaaatacaaaaaaagatttccctcaagattcccatgaacaattatggggagcaataagtgccgtatttcaatcttggcaaaatcaaagagcaaaaacatacagaagattaaataatattcctgaagagtggggcacagcagtcaatattcaatctatggtgtttggtaatatgggcaatgattgtgcaacgggcgttgcatttaccagaaacccgtccacaggagaaaatagtttttatggagaatatttaattaatgcacaaggagaagatgttgttgcaggaattcgaactccaagaaatattactaaaaaagaaagattagagtcatcttctgaggatttatcattagaggagacaatgccagaagcattcgctgaacttacaaaaatttataaaaaattagagactcactaccgtgatatgcaggatattgaatttaccattgagaataaaaagctttggatgttacagacaaggtcagggaaaagaactgcaaaagcttcaattaagattgcagtagatatggttagtgaaaaattgatcacaaaagatgaggcattacttagaattgatccaaaaattttagatacacttcttcatccaactttagatccaaaagctaaaaaaaatataatagcaaaaggacttccagcatcaccaggtgctgcaaccggaaaagttacttttaatgcagacgatgccgagcaaatgaaggctaataatcaaaatactattttagttcgagttgaaacatctccagaagatattcacggaatgcacgctgctgttggaattttaacttgcagaggaggaatgacaagccatgccgctgttgttgcaagaggaatgggaagaccctgcgtttcaggcgctggagttataaaaatagattatgcagctaaacttttcaaagtagacaacgctgaagtaaaagagggcgacattattacaatcgatggttcaacaggcgaagtaatgcttggagaagttaagacaattaacccagacatctcaggagatttttctgagatgatgaaatgggccgatgaagttagaactttaaaaattagagcaaacgccgaaaccccattagactctcgaactgctagaggatttggtgctgaaggaattggactttgtagaacagagcatatgttttttgatgaagaaagaattttatatgtaagacagatgatcctttcaaaaactaaagaagatcgtctaaaagccttagataaaattttaccatttcaaagaaaagattttgtcgaaatttttacaatcatgaaaggtctacctgttacagttagactgttagatcctcctttgcatgaatttttaccaaaaactgaaaaagaaatagatattgtagcgaaatctttaaaaattcattcaagtgaaattaaaaatagaattaattatttgcatgaagaaaatcctatgctgggtcacagaggttgtcgtctagcaatttcttttcctgaaatttacgaaatgcaatgtcgagcaatttttgaagctttatatgaattacaaaaacaaaaagttgaagctgtcattccggaaattatgattccacttgttgcaacagaaagagaaattgaaattttaagagaattagt

SEQ ID NO: 1622 - DNA, 4000 bp, Escherichia coli
  misc_feature (1567)..(1567): n is a, c, g, or t
  misc_feature (1985)..(1986): n is a, c, g, or t
  misc_feature (1993)..(1993): n is a, c, g, or t
tttcgcagcctgatctgttaggtttgatacatcataagttaatgtatacagcatctttgaagtgctgtcggtcacaggtcttgcttccataaacccgtggtaaagatcatagaactccccttccaccgcaggttgcgtatacccataggaaagcgcagtttgcgccaccatgatttcgattacacgcccacccataagtgagcgcactgatcccataccgccatcgccggaagtaatctcacaaggcagcctcaaccactcactaatggcgcagtaattgccgaccttttcccaaacttctgcggcaggtttgttgatgtcgatctccatatcgatggtcacatattcctgtgccatcgctggaaagaaaactagtagagctacaactgcaagcactggttttaatatatagcgcatagggccttcctcattgataatcgcgatgtcggatgatccagtagataaccatccctaacgcgcggggctcttttatactgacagaagagcaagaaaagaggggcaagtagtatcagacatgtcaatgacatgtcacatcatgtagggcatgagaaaaatttaaagatatgaggcagaattcagagaggctttaataaatatcgaagcttgatttcgatgctttgcgtttgacagtggcgccgtcagttagaaccgccgagcaatctccgcactgcagaagtctctgcgtcttccagcgagcgcgacaaattgcttaaagcatcaaattgctcgtccgcgagcacccatccattggcagatgtaatttcgtcaacgcaagaaaacatactgacgaaattatcggtctcagattgcacggtaatgggttttctttgatttgcataacaggatagaaaatcatcaaggataaaatctattgttatatcagaatttcgctgaagctcacctcccgacattgagagaatcctggcaataaacctcaaggtgcttacttctagcaaagtaacgctagcgttttgcgatgtcacatcttcctgcattctgagcaacgaaggtattggtcgttctccaaaatagccaacgtactcatttactacttcctccaggctagaccgtgcttgtttatagggttctgaccaattgaaatttgaatcagaagtcggcgcctgtgccaccgcaagttggttatgttcagcagaaagttgcccgatctgagagtaaagatcgttgatgagataggctgagactgcgatgaaagaagctgttaggtaagatagccaacctacccttgagggagggagagttgagcctaaccatgccgataagcttccttttcggggcctcttcttctgtggagacgactctctagatgaagacatgaaatcggagaagggtagctcgaatagagctgctaacgctttagcgctttctacggaaggctggacttgcccgttctcaatgcggtgaatagtcctgacactcaatccggtcaggtcggacagatccgattgcgaccatcctttctcttttctcagttcttttatgtccatttctcggaccggatagcgtattagagccacttgaatagatngcgtattgttatgtcactgcgtgatttcgaaatagtctacacccatgcttgtagccagtcacgtagggctcaacctaatttcgttgcttttcgtcgcaaagacccgaccaaatgggggctatatctgggttcgtggagcagtttggaccaaattcttcaaagaaaacgcggccttaagtccttaccattagggaattcgctgctatcccttgatttccaatctggaaaggcaaaagctattgagtttagagcccgtggccccctaacgctcagcgcaatgaactgccttccatcaaatgtcataatgaggaagctttcctcttgtctagacgttagaggttaccatttagacatctgtcccgagtttcacagctagaaaatcttcaagaagcttgactcacttttttatttctgtatnntctttcnccgcaccgatttgatccagattgcggggtgcgttacaaataccagctaaatcggacccactttttggaacccgatctagcgccgctgggtcgggttttttcgtttcagcctatggttagcccatacatctcacttacggggtggccatgaaacgacccgtctacagaaagcaagtgtcatgtcgtgatttgatcctattgccgcgacaaaaaagaaagcgctaaaacggaatctttcccaggatccaacattgactagatggagtttttctatgcgaaaactgtatgttaacgcgcgttatttattagtgcctgcgatgacgatcgcaacaatcattggactatatttgggaggattttacgtatggcttggagtcgtgctttttggggtaaataccatcctggatactcttacgaaagatatacatctccgggcagattttgatgattcaggaaactcttttggagttaagggctttcaatactctgttatgtatctgatgcttccaatttttattgtcctgcagacagcgcttgcaaacaatctgtataagtttgtgtccctcggtgtgttggaaacaagcgagatcataggatctatcctgtcatgcggattgtgggcggggcttggcataatctacgggcatgaactctcgcacaacaaaaaagaaggctttgctgtttccagggcaataatggctctcagtggggcctcacactttacctatgctcatgtgttcaatcatcacttagatttgggacatgaaaaagacccggcgacagcccccagggggagaaatgtatatgcgcatgcctggctgtcgcatatgggtcagtcgaaattttcctatgatttagagcggaaaaaacttcagcaagctaatagtagatttctgtctactcgaaatatgtggttgcgcggctatctctatagccttcctactgtcgtgcttttcgtttggagtggaggcatcgtcggcgtggctgcccttttggccgtctggtcaatatcaaatttccttttagaggcgctcaatttcatgggccattacggtctaatccgggaacaaagtaaacctgttgagcacaggcattcttgggataacgataatttattcacgagctggtttttcatcgaaataggtcggcagtgtgatcatcatgtgagaggtgaaacatttttttgggagctggatgatgtccaagggccaaattacgggattggatatttctctctattcgtcttaaccctcataccaggcctttttcgggcgtttgttcagaagcatcttgataattgggataacaacttcgcaacggaaggtgaaaagaaaattatcgaagaatatttcccgaataagacaagtttattgggcgcatagcaatgctccagcgactgttaaatagaaaaaaatccttctctgtgaacgtctcacctggcaatcatcattttgcgctcgaccggaaagagactctattggctggagcgctgaaagccggcctgaattggcctcacaagtgccaagttggtagttgtgggagatgcaaatgcaaaattctcgacggcgctataagaccggagattgatttcaactacgtcttgacgcctgctgaagtcagagctggatatattctcgcttgtcagtcaacgccaaaaacagatctaaaagtaactgtaaacctcctcaacaaaggaaattagcaatgaaaaataatctcgccttttttgcaatgatcacatggacaatatctgcgggcgcaggtttgtatttttcggggatactcgcccagcacacagcaattggctggtcattaatagcagcattaattttgctgggtatccatattggaaatctaattctatatttcaagttagctggtgatgaaccatacaaatggaaacgagagagcgaggccaaaggcgttagcgcgtaattcttatgaagaaaacagaacaggattatctaatatttaccggtacctgcaatgcaggtaccggtgttgttgc

SEQ ID NO: 1623 - DNA, 4000 bp, Escherichia coli
  misc_feature (627)..(627): n is a, c, g, or t
  misc_feature (918)..(918): n is a, c, g, or t
  misc_feature (939)..(939): n is a, c, g, or t
  misc_feature (1050)..(1050): n is a, c, g, or t
  misc_feature (1302)..(1302): n is a, c, g, or t
  misc_feature (1320)..(1320): n is a, c, g, or t
  misc_feature (1434)..(1434): n is a, c, g, or t
  misc_feature (1452)..(1452): n is a, c, g, or t
  misc_feature (1455)..(1455): n is a, c, g, or t
  misc_feature (1521)..(1521): n is a, c, g, or t
  misc_feature (2210)..(2210): n is a, c, g, or t
tggtccctcggcatccgacccgtcttcaaaaccgtcgacacctgcgccgccgaattcgaagccaccaccccctactactactccagctacgaactcgaccccgccgccgaaaccgaagtcaccccccaaaccaccaaagaaaaaatcatcatcctcggctccggccccaaccgcatcggccaaggcatcgaattcgactactcctgcgtccacgcagccctagaactctcccgcgtcggatacgaaaccgtcatggtcaactgcaaccccgaaaccgtctccaccgactacgacaccgccgaccgcctctacttcgaacccctcaccttcgaagacgtcatggaggtctaccacgccgaaacccaatccggcaccgtcgccggcgtcatcgtccaactcggcggccaaacccccctcggactcgccgaaaaactccgcgacgccggcgtcccagtcatcggcaccacccccgaagccatcaacctcgccgaagaccgcggcgaattcggcgaagtactccacgccgccaacctccccgcacccgccttcggcaccgccaccagcttcgccgaagccaaaaacgtcgccaaccacatcggctaccccgtcctcgtccgcccctcctangtcctcggcggccgcggcatggaaatcgtctacgacgaaccctccctcgccgactacatccaacgagccaccgaaatcacctccgaccaccccgtcctcgtcgaccgcttcctcgacaacgccatcgaaatcgacgttgacgccctctgcgacggcaccgacgtctacctcgccggcgtcatggaacacatcgaagaagccggcatccactccggcgactccgcctgcgccctcccacccatgaccctcggccccgaagacatcgacaaagtccgcgcctccaccgtcgcnctcgcccacggcatcggcgtncacggcctcatgaacgtccaattcgccctcaaagacgacatcctctacgttattgaagccaacccccgcgcctcccgcaccgtccccttcgtctccaaagccaccggcgtncacctcgccaaagccgccgcccgcatcatgaccggcaccaccatcgcccagctcaaagccgaaggactcatccccaccgactacgacggcggctccctgcccctcgacgcccccatcgccgtgaaagaagccgtcctccccttcaaccggttccgccgccccgacggcacctccctcgacaccctcctctccccggaaatgaaatccaccggcgaagtcatgggcctcgccgacaacttcggcgccgcctangccaaagccgaacaggcngccttcggtgccctccccaccaccggcaccgtcttcgtctcggtagccaaccgggacaaacgcaccctcattttccccatccaacgcctcgcctccctcggattcaccatgctngccaccaccggcaccgcngcnatgctgcgccgcaacggtgtgcaatgcgaaaccgtcctcaaacactccgacgtcgcccaacccggngatacccggaaatccattgtggatttgatccgcgccggggaggtggacctgattttgaacacgccggccgggtcggcgggcgcacggcatgatggctatggcattcgggcggccgccgtgaatgtgggcgtgcccctgattaccaccgtgcagggggtgacggctgcggtgcagggcattgaagcactgcaacgaggcgggttgggggtgcgtgcgctgcaagaactcgaccactcgccgaaacacgccgcctatgtggccgccaaaaccgccgccgaagactcaatggggaaaggggagtagggtccatgcacgactcgggcaacactgactctgatagcacctttggggagaaactccgggcggcgggggagcggcacggccgcctctgcgtgggcatcgacccacacaaatccctgctcgaatcctggggattcgaaaacaccatcgagggattggccgcgttcagcaccatctgtgtggatgccttcgctggccatgtagcgttagtgaaaccccaagtggcgttttacgaggccttcggttcagacgggtttgccgtgctagaaaccaccatggccgcgctgcgttcggctggaacgctggtggtggcggacgcaaaacggggcgatattggctccaccatggcgggctatgccgaagcatggttgacaccaggatcgcccctngaggcggatgctgtgacgttatcaccctacctggggttcgaatcgctccgccccgcacttgacatcgcacaaaaattcggtaaaggggtgtttgtgttggcggccaccagtaacccagaagccgccaccgtgcagggttgccacacggagcacggggtcaccatatcacagcagatcgtcgacgcatgcgcgcaggaaaactcggcctaccagccggcggttggaagcgtcggagtggtggtgggtgccaccttggctacgccaccagatttgcggaaactccatggtccggtgctgctccccggagtgggggcacagggggcaaccgccaaagatgttaagcggatcacaaaagatttggtggggttgagttttcccagcgtatcgcggggtatcctttcggtcgggccgaaagtttctactctgaaaaaagccgtagacaatgtggtgaaagaaatttaatatttgaccatttcgccagttcgcgtcacacgataggggcgaaatggacgcctattgacctgcgactttccaattgaaattggcgattacctgatcttttgtgattaggtgctacactggggcgaaatctaccgggatattcccagtgcatgtttcctgcgtgtatggtagatttccgcaggtggaatcatttactgattttcactgcaacctatagacatttatcgaacttattgaatcggaggaatcccgtggcccttccacagttgaccgatgagcagcgcaaagaagccctcgctaaggctgccgaggcgcgtaaggcacgtgcagagctcaaagagcagctcaagcgcggtgacatttccctgaaggaggttttggcaaaggcctccagcgacgaaatcattggtaagaccaaggtctcggctcttttggaatccttgcccaaggttggcaaggtgaaggctaaggaaatcatggacgagctggagatcgcccagactcgccggctgcggggcttgggtgaccgtcagcgtcgcgccctgctggagcgtttcggtttctctgaggactaaaacgtggttggcgataaccctcatcagggccggttagtggtattacttggcccgtctgccgtgggaaagtccacggtggttcatcgcctccgcgaagaattgcccaccatgtatttttcggtctctatgaccacccgtgctccccgccctggggaggtagatggtgtgcactatttcttcgtgacccccgaggagttccaacgtcgaattgacgccggtgaaatgctcgaatgggcggatattcacggcgggctgcaacgttcgggaactcccgcgggccccgtcgaccaggcgctttcggccggccgcccagtgttggtggaggtagatctggtgggggctcgtgcgatcgccgccataaaacccgaggcggagactgtgtttttagcgcccccttcatgggaagtgctggtggaacggctcactgggcgtggtacggaatctgatgctactattcagcgtcggttagaaaccgctcgggtagaacttgcggcgcagaacgaattccggcacgtcattgtcaacgatgatgtggagcgggcggtagcccaattgcggaatattttgttaggcgtcaagtgagccgattgggtcccgcatatttgagggactaagctagaaaccgcagtataaacgttcaagtaaaggtatcaatatctcgtgagcaaagtgtcggaaagcaatcagcgcgtctacgataagccgatcggtatcactgatccgccaattgatgagctactggaccacgtatcc

SEQ ID NO: 1624 - DNA, 4000 bp, Escherichia coli
  misc_feature (2)..(4): n is a, c, g, or t
  misc_feature (6)..(16): n is a, c, g, or t
  misc_feature (18)..(19): n is a, c, g, or t
  misc_feature (21)..(25): n is a, c, g, or t
  misc_feature (27)..(27): n is a, c, g, or t
  misc_feature (29)..(29): n is a, c, g, or t
  misc_feature (33)..(33): n is a, c, g, or t
  misc_feature (39)..(39): n is a, c, g, or t
  misc_feature (41)..(43): n is a, c, g, or t
  misc_feature (45)..(45): n is a, c, g, or t
  misc_feature (47)..(51): n is a, c, g, or t
  misc_feature (53)..(55): n is a, c, g, or t
  misc_feature (57)..(60): n is a, c, g, or t
  misc_feature (64)..(66): n is a, c, g, or t
  misc_feature (71)..(72): n is a, c, g, or t
  misc_feature (82)..(82): n is a, c, g, or t
  misc_feature (86)..(86): n is a, c, g, or t
  misc_feature (89)..(90): n is a, c, g, or t
  misc_feature (92)..(92): n is a, c, g, or t
  misc_feature (94)..(94): n is a, c, g, or t
  misc_feature (96)..(98): n is a, c, g, or t
  misc_feature (101)..(102): n is a, c, g, or t
  misc_feature (104)..(105): n is a, c, g, or t
  misc_feature (107)..(110): n is a, c, g, or t
  misc_feature (113)..(114): n is a, c, g, or t
  misc_feature (116)..(117): n is a, c, g, or t
  misc_feature (120)..(124): n is a, c, g, or t
  misc_feature (126)..(126): n is a, c, g, or t
  misc_feature (128)..(128): n is a, c, g, or t
  misc_feature (130)..(132): n is a, c, g, or t
  misc_feature (134)..(136): n is a, c, g, or t
  misc_feature (138)..(138): n is a, c, g, or t
  misc_feature (140)..(140): n is a, c, g, or t
  misc_feature (143)..(154): n is a, c, g, or t
  misc_feature (156)..(158): n is a, c, g, or t
  misc_feature (160)..(161): n is a, c, g, or t
  misc_feature (163)..(164): n is a, c, g, or t
  misc_feature (167)..(169): n is a, c, g, or t
  misc_feature (171)..(171): n is a, c, g, or t
  misc_feature (173)..(180): n is a, c, g, or t
  misc_feature (182)..(189): n is a, c, g, or t
  misc_feature (191)..(192): n is a, c, g, or t
  misc_feature (194)..(194): n is a, c, g, or t
  misc_feature (197)..(197): n is a, c, g, or t
  misc_feature (199)..(224): n is a, c, g, or t
  misc_feature (226)..(228): n is a, c, g, or t
  misc_feature (230)..(230): n is a, c, g, or t
  misc_feature (232)..(234): n is a, c, g, or t
  misc_feature (236)..(236): n is a, c, g, or t
  misc_feature (238)..(238): n is a, c, g, or t
  misc_feature (240)..(240): n is a, c, g, or t
  misc_feature (242)..(243): n is a, c, g, or t
  misc_feature (246)..(246): n is a, c, g, or t
  misc_feature (248)..(249): n is a, c, g, or t
  misc_feature (251)..(258): n is a, c, g, or t
  misc_feature (260)..(267): n is a, c, g, or t
  misc_feature (269)..(283): n is a, c, g, or t
  misc_feature (285)..(296): n is a, c, g, or t
  misc_feature (298)..(302): n is a, c, g, or t
  misc_feature (304)..(304): n is a, c, g, or t
  misc_feature (306)..(308): n is a, c, g, or t
  misc_feature (310)..(314): n is a, c, g, or t
  misc_feature (316)..(317): n is a, c, g, or t
  misc_feature (319)..(319): n is a, c, g, or t
  misc_feature (322)..(323): n is a, c, g, or t
  misc_feature (327)..(327): n is a, c, g, or t
  misc_feature (329)..(329): n is a, c, g, or t
  misc_feature (331)..(332): n is a, c, g, or t
  misc_feature (334)..(335): n is a, c, g, or t
  misc_feature (337)..(340): n is a, c, g, or t
  misc_feature (342)..(360): n is a, c, g, or t
  misc_feature (362)..(365): n is a, c, g, or t
  misc_feature (367)..(373): n is a, c, g, or t
  misc_feature (375)..(378): n is a, c, g, or t
  misc_feature (380)..(380): n is a, c, g, or t
  misc_feature (382)..(384): n is a, c, g, or t
  misc_feature (386)..(387): n is a, c, g, or t
  misc_feature (389)..(389): n is a, c, g, or t
  misc_feature (392)..(401): n is a, c, g, or t
  misc_feature (403)..(407): n is a, c, g, or t
  misc_feature (409)..(409): n is a, c, g, or t
  misc_feature (412)..(412): n is a, c, g, or t
  misc_feature (414)..(417): n is a, c, g, or t
  misc_feature (420)..(433): n is a, c, g, or t
  misc_feature (435)..(438): n is a, c, g, or t
  misc_feature (440)..(441): n is a, c, g, or t
  misc_feature (443)..(462): n is a, c, g, or t
  misc_feature (464)..(466): n is a, c, g, or t
  misc_feature (468)..(476): n is a, c, g, or t
  misc_feature (478)..(478): n is a, c, g, or t
  misc_feature (480)..(481): n is a, c, g, or t
  misc_feature (484)..(484): n is a, c, g, or t
  misc_feature (488)..(488): n is a, c, g, or t
  misc_feature (490)..(495): n is a, c, g, or t
  misc_feature (499)..(517): n is a, c, g, or t
  misc_feature (520)..(523): n is a, c, g, or t
  misc_feature (525)..(525): n is a, c, g, or t
  misc_feature (530)..(531): n is a, c, g, or t
  misc_feature (534)..(534): n is a, c, g, or t
  misc_feature (537)..(538): n is a, c, g, or t
  misc_feature (540)..(540): n is a, c, g, or t
  misc_feature (543)..(544): n is a, c, g, or t
  misc_feature (546)..(547): n is a, c, g, or t
  misc_feature (549)..(550): n is a, c, g, or t
  misc_feature (552)..(556): n is a, c, g, or t
  misc_feature (558)..(561): n is a, c, g, or t
  misc_feature (564)..(567): n is a, c, g, or t
  misc_feature (569)..(579): n is a, c, g, or t
  misc_feature (581)..(581): n is a, c, g, or t
  misc_feature (583)..(588): n is a, c, g, or t
  misc_feature (590)..(593): n is a, c, g, or t
  misc_feature (596)..(596): n is a, c, g, or t
  misc_feature (598)..(598): n is a, c, g, or t
  misc_feature (600)..(600): n is a, c, g, or t
  misc_feature (603)..(603): n is a, c, g, or t
  misc_feature (606)..(606): n is a, c, g, or t
  misc_feature (608)..(609): n is a, c, g, or t
  misc_feature (611)..(619): n is a, c, g, or t
  misc_feature (622)..(624): n is a, c, g, or t
  misc_feature (627)..(642): n is a, c, g, or t
  misc_feature (644)..(645): n is a, c, g, or t
  misc_feature (647)..(647): n is a, c, g, or t
  misc_feature (650)..(651): n is a, c, g, or t
  misc_feature (654)..(655): n is a, c, g, or t
  misc_feature (658)..(660): n is a, c, g, or t
  misc_feature (662)..(663): n is a, c, g, or t
  misc_feature (666)..(667): n is a, c, g, or t
  misc_feature (669)..(670): n is a, c, g, or t
  misc_feature (672)..(674): n is a, c, g, or t
  misc_feature (676)..(677): n is a, c, g, or t
  misc_feature (679)..(685): n is a, c, g, or t
  misc_feature (693)..(694): n is a, c, g, or t
  misc_feature (696)..(696): n is a, c, g, or t
  misc_feature (698)..(698): n is a, c, g, or t
  misc_feature (700)..(700): n is a, c, g, or t
  misc_feature (702)..(704): n is a, c, g, or t
  misc_feature (706)..(706): n is a, c, g, or t
  misc_feature (708)..(708): n is a, c, g, or t
  misc_feature (710)..(713): n is a, c, g, or t
  misc_feature (717)..(717): n is a, c, g, or t
  misc_feature (719)..(725): n is a, c, g, or t
  misc_feature (727)..(727): n is a, c, g, or t
  misc_feature (729)..(730): n is a, c, g, or t
  misc_feature (735)..(737): n is a, c, g, or t
  misc_feature (739)..(739): n is a, c, g, or t
  misc_feature (742)..(743): n is a, c, g, or t
  misc_feature (745)..(746): n is a, c, g, or t
  misc_feature (749)..(751): n is a, c, g, or t
  misc_feature (753)..(753): n is a, c, g, or t
  misc_feature (756)..(756): n is a, c, g, or t
  misc_feature (759)..(759): n is a, c, g, or t
  misc_feature (761)..(763): n is a, c, g, or t
  misc_feature (765)..(765): n is a, c, g, or t
  misc_feature (767)..(768): n is a, c, g, or t
  misc_feature (771)..(773): n is a, c, g, or t
  misc_feature (778)..(778): n is a, c, g, or t
  misc_feature (780)..(780): n is a, c, g, or t
  misc_feature (782)..(785): n is a, c, g, or t
  misc_feature (787)..(787): n is a, c, g, or t
  misc_feature (789)..(789): n is a, c, g, or t
  misc_feature (791)..(796): n is a, c, g, or t
  misc_feature (799)..(799): n is a, c, g, or t
  misc_feature (801)..(801): n is a, c, g, or t
  misc_feature (803)..(803): n is a, c, g, or t
  misc_feature (805)..(807): n is a, c, g, or t
  misc_feature (812)..(812): n is a, c, g, or t
  misc_feature (814)..(819): n is a, c, g, or t
  misc_feature (824)..(827): n is a, c, g, or t
  misc_feature (829)..(833): n is a, c, g, or t
  misc_feature (836)..(838): n is a, c, g, or t
  misc_feature (840)..(840): n is a, c, g, or t
  misc_feature (842)..(843): n is a, c, g, or t
  misc_feature (850)..(850): n is a, c, g, or t
  misc_feature (853)..(853): n is a, c, g, or t
  misc_feature (856)..(857): n is a, c, g, or t
  misc_feature (859)..(859): n is a, c, g, or t
  misc_feature (861)..(862): n is a, c, g, or t
  misc_feature (864)..(868): n is a, c, g, or t
  misc_feature (871)..(871): n is a, c, g, or t
  misc_feature (873)..(876): n is a, c, g, or t
  misc_feature (878)..(880): n is a, c, g, or t
  misc_feature (882)..(886): n is a, c, g, or t
  misc_feature (888)..(890): n is a, c, g, or t
  misc_feature (895)..(898): n is a, c, g, or t
  misc_feature (900)..(902): n is a, c, g, or t
  misc_feature (906)..(910): n is a, c, g, or t
  misc_feature (912)..(912): n is a, c, g, or t
  misc_feature (915)..(915): n is a, c, g, or t
  misc_feature (917)..(919): n is a, c, g, or t
  misc_feature (921)..(922): n is a, c, g, or t
  misc_feature (925)..(925): n is a, c, g, or t
  misc_feature (927)..(927): n is a, c, g, or t
  misc_feature (930)..(931): n is a, c, g, or t
  misc_feature (935)..(935): n is a, c, g, or t
  misc_feature (938)..(940): n is a, c, g, or t
  misc_feature (948)..(950): n is a, c, g, or t
  misc_feature (953)..(953): n is a, c, g, or t
  misc_feature (956)..(957): n is a, c, g, or t
  misc_feature (959)..(959): n is a, c, g, or t
  misc_feature (962)..(963): n is a, c, g, or t
  misc_feature (965)..(967): n is a, c, g, or t
  misc_feature (969)..(969): n is a, c, g, or t
  misc_feature (972)..(974): n is a, c, g, or t
  misc_feature (976)..(976): n is a, c, g, or t
  misc_feature (978)..(978): n is a, c, g, or t
  misc_feature (982)..(982): n is a, c, g, or t
  misc_feature (986)..(988): n is a, c, g, or t
  misc_feature (993)..(993): n is a, c, g, or t
  misc_feature (996)..(997): n is a, c, g, or t
  misc_feature (999)..(999): n is a, c, g, or t
  misc_feature (1001)..(1002): n is a, c, g, or t
  misc_feature (1005)..(1007): n is a, c, g, or t
  misc_feature (1009)..(1009): n is a, c, g, or t
  misc_feature (1011)..(1012): n is a, c, g, or t
  misc_feature (1015)..(1017): n is a, c, g, or t
  misc_feature (1019)..(1022): n is a, c, g, or t
  misc_feature (1024)..(1025): n is a, c, g, or t
  misc_feature (1030)..(1032): n is a, c, g, or t
  misc_feature (1034)..(1034): n is a, c, g, or t
  misc_feature (1039)..(1039): n is a, c, g, or t
  misc_feature (1041)..(1046): n is a, c, g, or t
  misc_feature (1306)..(1306): n is a, c, g, or t
  misc_feature (1749)..(1749): n is a, c, g, or t
  misc_feature (1988)..(1988): n is a, c, g, or t
  misc_feature (1992)..(1992): n is a, c, g, or t
  misc_feature (3693)..(3693): n is a, c, g, or t
  misc_feature (3695)..(3698): n is a, c, g, or t
  misc_feature (3702)..(3706): n is a, c, g, or t
  misc_feature (3709)..(3711): n is a, c, g, or t
  misc_feature (3714)..(3722): n is a, c, g, or t
  misc_feature (3726)..(3730): n is a, c, g, or t
  misc_feature (3733)..(3735): n is a, c, g, or t
  misc_feature (3740)..(3740): n is a, c, g, or t
  misc_feature (3745)..(3745): n is a, c, g, or t
  misc_feature (3749)..(3750): n is a, c, g, or t
  misc_feature (3753)..(3756): n is a, c, g, or t
  misc_feature (3758)..(3758): n is a, c, g, or t
  misc_feature (3760)..(3764): n is a, c, g, or t
  misc_feature (3767)..(3771): n is a, c, g, or t
  misc_feature (3773)..(3773): n is a, c, g, or t
  misc_feature (3775)..(3775): n is a, c, g, or t
  misc_feature (3779)..(3779): n is a, c, g, or t
  misc_feature (3781)..(3783): n is a, c, g, or t
  misc_feature (3786)..(3791): n is a, c, g, or t
  misc_feature (3793)..(3795): n is a, c, g, or t
  misc_feature (3798)..(3801): n is a, c, g, or t
  misc_feature (3805)..(3813): n is a, c, g, or t
  misc_feature (3815)..(3827): n is a, c, g, or t
  misc_feature (3829)..(3841): n is a, c, g, or t
  misc_feature (3845)..(3846): n is a, c, g, or t
  misc_feature (3850)..(3851): n is a, c, g, or t
  misc_feature (3853)..(3856): n is a, c, g, or t
  misc_feature (3859)..(3861): n is a, c, g, or t
  misc_feature (3863)..(3871): n is a, c, g, or t
  misc_feature (3873)..(3873): n is a, c, g, or t
  misc_feature (3875)..(3875): n is a, c, g, or t
  misc_feature (3880)..(3883): n is a, c, g, or t
  misc_feature (3886)..(3891): n is a, c, g, or t
  misc_feature (3893)..(3899): n is a, c, g, or t
  misc_feature (3902)..(3903): n is a, c, g, or t
  misc_feature (3905)..(3905): n is a, c, g, or t
  misc_feature (3907)..(3909): n is a, c, g, or t
  misc_feature (3917)..(3919): n is a, c, g, or t
  misc_feature (3921)..(3922): n is a, c, g, or t
  misc_feature (3925)..(3931): n is a, c, g, or t
  misc_feature (3935)..(3936): n is a, c, g, or t
  misc_feature (3938)..(3939): n is a, c, g, or t
  misc_feature (3941)..(3950): n is a, c, g, or t
  misc_feature (3953)..(3955): n is a, c, g, or t
  misc_feature (3957)..(3958): n is a, c, g, or t
  misc_feature (3961)..(3961): n is a, c, g, or t
  misc_feature (3963)..(3964): n is a, c, g, or t
  misc_feature (3966)..(3972): n is a, c, g, or t
  misc_feature (3974)..(3975): n is a, c, g, or t
  misc_feature (3977)..(3977): n is a, c, g, or t
  misc_feature (3979)..(3981): n is a, c, g, or t
  misc_feature (3984)..(3986): n is a, c, g, or t
  misc_feature (3988)..(3988): n is a, c, g, or t
  misc_feature (3990)..(3991): n is a, c, g, or t
  misc_feature (3993)..(3993): n is a, c, g, or t
  misc_feature (3996)..(4000): n is a, c, g, or t
gnnngnnnnnnnnnnngnncnnnnngngngcgngcgcgngnnngngnnnnngnnngnnnncgcnnncgccnncgcccccccncccnccnncncncnnnccnncnncnnnnccnncnnccnnnnncncncnnncnnncncnccnnnnnnnnnnnncnnngnngnncgnnngngnnnnnnnncnnnnnnnncnncntcntnnnnnnnnnnnnnnnnnnnnnnnnnngnnngngnnngngngngnnggngnngnnnnnnnncnnnnnnnnannnnnnnnnnnnnnngnnnnnnnnnnnncnnnnncncnnncnnnnncnncnccnnccgncngnngnncnnnngnnnnnnnnnnnnnnnnnnngnnnngnnnnnnngnnnngngnnngnncncgnnnnnnnnnncnnnnncncgngnnnncgnnnnnnnnnnnnnngnnnngnngnnnnnnnnnnnnnnnnnnnnannncnnnnnnnnngngnncgngcgngnnnnnncgannnnnnnnnnnnnnnnnnngcnnnngnggggnnggnggnngnggnngnngnngnnnnngnnnncgnnnngnnnnnnnnnnngngnnnnnncnnnnccncncngcngcncnncnnnnnnnnncgnnngannnnnnnnnnnnnnnngnncncgnncgnncgnnngnnggnngnngnnngnncnnnnnnngcctactnngncngncnnntnantnnnnttantnnnnnnntngnncgcgnnngncgnnanntgnnnanggncgncnnncngnnccnnnctccngngnnnncngngnnnnnngcngnanannnacggngnnnnnncgcgnnnncnnnnncannncncnnaaacgcncgncanncncnncnnnnncgncnnnncnnncnnnnngnnncggcnnnntnnntcgnnnnnancgntnnnanncgncncgnncccncgnnncgccgcgnnncgncgnngngcnncnnncncgnnngncnccgnaggnnnccgancgnncncnncgnnncncnngcnnncnnnncnnccgannngnccgangnnnnnncgggagcccgaaggtcgcgtcggggcggacgcgattcgcgtccgtcggtcgccggcgcatcgccgcgtcggactcgagacgcgcgcgtggtatccgcctcgatccgccggaggctcgaaagactgacctcgctcttccctgccgcgcgtccgcgtcggtcgatcccccgtcgacccttttcttttctcgtctgccgccctcgcagacgctctcgacgcagccaaggtctttcttttccgaacgcaaattttttttagtgnaacgtgacgcgatgaaagtcaccgtcgccaccacctcggcggcgcgccgttcgggcgccgagctcaaggcgttcgacgtcaaggcctccacggtcgtcgaagggttcaaggtgacctgcgtcgtgaagccggcgacgccctccgtgtcgttcgaccccgcgtttcgactcaacaccaagccgccgtcggcgacggcggacgccaccgtcgccaaggacggcgtgacgctcttcctggacaacctgcaggacgcggtttcgaaaaaaaaactggcgccgcgcgtcaaggtggagcgcaaggtgaccgtcgccggcgaggcgtacgcggtggacgccgaactcgcgatgaagggcaacatcaagaccgccgacgtggtcacggtgagcgtcaaggcgcccgcgctcgccgggttcgcgcccaaagccacgtacagcaccgggccnaaaggtttgtctctggtgctcgccggcgacgtcgccggcggcgacaccaacgtcgagctcaaggcggagcacttcccgaagaaggcgggcgcgccgaccgcgctcaccgccgcggtcacgcagaagctccccgagaagatcaaggctaagctgacgctcaaggacgacctgtccggctcggtcgagctgcacaagggcgcggcatccatcgaggcgccgctcgggaagggcgggaaaangccnggcgtcggcgacgtcgtcttcaagtacaaaaagtccttcgagtacgacctgtgaggactcccacgttcgtggacgttccggtgcgtcgttcggagaaccctctatggccggcgcgactccgaagccccccgcgcgcggaactgtcccgtccgcggatgacggcgtctcacggtagctcgtctattttacacacttttctagtcgtcctcctcctcttcttcgctcgcggcggcgtcgtcggcgtcggcgtcggcgccctcgaggcacgcgcgtatcagctccatctcctgcgggctgcactccttccactgcccgacggtgagcccctcgagcccgatgcccatgatctccgtccggtgcaggtcccgcacgacgtacccgacggcgtcgaacatccggcggatctgccggttccgaccctcgcgcagcgtgatggccaccgccgcgtttcgcgtttctttcccgccgacgaaacgcacgtcgcacggtaacgtccgcgcggtcacgatcctgtccaccttgtccctcctcacgggcgtgctgatgaccacgccctcccgcagcgttcgcaggtcctcctcgcgtgccgggcggtccaagcacacgacgtacttcttctccttccgcgcgcgcgcgcgcagcgcggcgttgggaagccgcccgtcggaggtgagcaggatgagcccggtggagtctttgtccagcctgcccaccggaaacacgcgttcggggtaccgcacggcgtccaggatgttcgtgcggtcgcgccggtccgtcgtgcacgtgatgcccctcggcttccagtacttgacgtagcggaacgcgctcgtcgattgatcgaaggtttggtttttcgtctcccaatcgatcggctcgccgtcgaggcgcacgacgtccccggggaagacgcgcgcgcccgcggaggccaccgcgccgttcacggtgacccgcccccgctccaccagcttgtcgctctcgcgccgggacgtgaagtccttgaaacacttgttcacgcgcacgccgtcactcgcgctcggcgcgcgctcgcctctcggcggagacgcccctcgagagggcacgtctccgccgggcgcgcgcacgtccacgacgcggaagtcctcgccttcgtccagagaaacggtggattgcgcccacgcgcgggacctccgggggccggcgtggcgccacgcgccctcttcgccgcgcttggacccgcgtgggtcgtcctcctcgggggcaccctcgtcgcgcgcgatgcgctcgccccagcccacgcgaccggggccggcgtcgtcgcgaacgcgcctgcctccgtctcggccgccgcgaccgccgcgaccgccgcgaccgcccgcgcgcccgcgcgaacgcccgcgcgagggcgaagccgaccggcctcctccgcgcgagtaggcgagcgggacgaccgcgcgacgaagcggcggcgacggcggtgggcgcttcgcgaaatcgcgaagagtcgagtgcccccgcgtggtaggcaccacccacggcgtcgtcccggccggtcgcgtcccgcgacgcgcggccgggaccgccacccccacgggcgcgagcgacgccatggtgtccgcgcgaccgagactgcggcgcgaggatgccggaagagcgacttgagacggacggggtaaacagtgtcctgaagttcagtttgtacagcagctgatataaatcacgcangnnnnaaannnnnccnnnttnnnnnnnnngagnnnnnccnnngcgcnccccncgcnncgnnnncncnnnnnaannnnncncncccncnnntcnnnnnncnnntcnnnngcgnnnnnnnnntnnnnnnnnnnnnngnnnnnnnnnnnnncgcnncggnngnnnncgnnncnnnnnnnnncncnccccnnnnccnnnnnnannnnnnngcnncncnnngcgcgcgnnncnngannnnnnncgcnncnncnnnnnnnnnnccnnncnncgngnngnnnnnnntnntntnnntgnnntncnncnccnnnnn

SEQ ID NO: 1625 - DNA, 4000 bp, Escherichia coli
  misc_feature (166)..(167): n is a, c, g, or t
  misc_feature (170)..(170): n is a, c, g, or t
  misc_feature (368)..(368): n is a, c, g, or t
  misc_feature (401)..(401): n is a, c, g, or t
  misc_feature (452)..(452): n is a, c, g, or t
  misc_feature (1441)..(1441): n is a, c, g, or t
  misc_feature (1594)..(1594): n is a, c, g, or t
  misc_feature (1600)..(1600): n is a, c, g, or t
  misc_feature (1992)..(1992): n is a, c, g, or t
  misc_feature (2050)..(2050): n is a, c, g, or t
  misc_feature (2524)..(2524): n is a, c, g, or t
  misc_feature (2593)..(2593): n is a, c, g, or t
  misc_feature (2599)..(2599): n is a, c, g, or t
  misc_feature (2635)..(2635): n is a, c, g, or t
  misc_feature (2656)..(2656): n is a, c, g, or t
  misc_feature (2750)..(2750): n is a, c, g, or t
  misc_feature (2863)..(2863): n is a, c, g, or t
  misc_feature (3019)..(3019): n is a, c, g, or t
  misc_feature (3141)..(3141): n is a, c, g, or t
  misc_feature (3146)..(3146): n is a, c, g, or t
  misc_feature (3156)..(3157): n is a, c, g, or t
  misc_feature (3172)..(3173): n is a, c, g, or t
  misc_feature (3191)..(3191): n is a, c, g, or t
  misc_feature (3214)..(3214): n is a, c, g, or t
  misc_feature (3223)..(3223): n is a, c, g, or t
  misc_feature (3227)..(3227): n is a, c, g, or t
  misc_feature (3270)..(3270): n is a, c, g, or t
  misc_feature (3279)..(3279): n is a, c, g, or t
  misc_feature (3293)..(3294): n is a, c, g, or t
  misc_feature (3322)..(3322): n is a, c, g, or t
  misc_feature (3328)..(3328): n is a, c, g, or t
  misc_feature (3331)..(3331): n is a, c, g, or t
  misc_feature (3357)..(3357): n is a, c, g, or t
  misc_feature (3392)..(3392): n is a, c, g, or t
  misc_feature (3395)..(3395): n is a, c, g, or t
  misc_feature (3433)..(3434): n is a, c, g, or t
gcaggcggtcggcgcgcacgcgggtttgcaggtctttattcaggtcgttggtgcccatcaccatacattgcagcttgggatgcgcgccaatcgcggcggcattcagcatcgcaccgggggtttccatcatcgcccaaagcgggatgtcgcccgtgatttcggccanngcntccagatcggcggggctgccgactttgggcagcaaaatggcgtcgcagtccatcttcgccgcggcgcgggcatcgtcggcaccccattcggtgtccagcccgttgatgcggatcaccttataccggctgccatagccgccgtctttcagcgccgtggcgagtgtttcacgtgcagcggttttctcttccgggatcacngcgtcttcgaggtcaaagataatcgcatcggcnggcagcccgcgggctttgtctaacgcgcggtccttggagccggggatatanagaacggaacgcagggggcgggtgattttcgacatttgcgactctccaagaaataatgttgcgtgcaggtctgcatttttagacgaaaacttcaagcgcaaacgcgccgcagcgcagcgtcagataatttgcggctttaacgcggccttcaggttttgctgccagaaggaaaggcgtcttggtgcgtgtgtaagtgtaagaggtgtagaatggtaaaactgtttaacctgatcgggctggcaactgccgcggcggcggtggtggcgctgacgcaggatgtcgcggcgggaacgcgaaccgcaggttgtgacggatgccacaagatttccgcgaaaatttcgcacccgccgcaggatcaacaaactaaggaggcgggccccatttgatatgtcatagattataaaagcggcgaaaaaagatgcggatcgccggaacgcaatcgccacatcatcgttgatatcacaaccgagtgattatcacccggaacttctaaaggagtatcaacaatgaaacgtattcttggcacaaccgcaatcatcctgagcttgactggtcccgcatttgcagatgcacatgcagctggttttggtaccgtgacagcgcaagaaactgacttcttcgcgtccgacctgatcggcatgcgtatctacaattccgagacagaagttgaagcaaactccaccatcgccgctgacggcgaaaaggaatgggacgacatcggcgaaatcaacgacgtcctgctggattccgaaggcaacgttaaggccgtaatcctcggcattggcggcttcctcggcatgggtgagcgtgacgtaagcgtgaacatggacgagattcgcatcgtgaccgaagaaggtgacagcgacgaccgtttcctcgtggtgaacacaagcaaagagatgcttgaaaaagccccagcgttcgaacgtatggacgacgaagctgacatggaaaccgaagcaaacatggacgccaacgccgacatgaangctgacacagacatggcagcgaccgacatgaacgccgaagctgaggtcgacacagagaccgaaatggaagcggatgccgaagcactggcaaacgaagctgaaatggaagccgaagaagcagccgctgaaacagagcaggccgttgatgaagcnaccacngaaatggccgaaggggcaaacgaacttgagcaagacatggaacgccccatgctgacagccccagcggttgagcgtgaaggctatgccaacgccacagctgatgaagttgccgcgctgacagcagaagaccttgaagggtcctatgtttacggtgccaacgacgagaccgtcggtgaaatcggtgcccttgttatgggtgacaacggcgaagttggccaagttgtgatcaacgtcggtggtttcctgggcattggcgaaaagccagtagccgttacatgggacgagctgcaaatcatgaagaacgctgaaggcgacgacttccgcatctacatcgacagcagcgaagaagcgctggaagcacagcccgaataccaaggctaagcgtaacgctnagtcaaattcggcaatagcttgctgaaaagctgaccaagacgggatcgtttcgaaagnaacggtcccgttttttatggctctgcgcgatgtgacgtgatgccggaccaagcgcaacttgcacggtgcgcttcatttcggtatcccgaagcgaaatgtaaccctgtcggagtataccacatggccagacccaagatcgcgcttatcggcgcagggcaaatcgggggcacgcttgcccatctcgcagcaatcaaggaactgggcgacgttgtcctgttcgacatcgccgaaggtatcccgcagggtaaggccctcgatatcgcagaatcgggcccatccgccaaattcgacgcgaccatgaccggcgcgaacgactactctgaaatcgctggcgcagacgtttgcatcgtgactgccggtgttgcgcgtaagcccggtatgagccgtgatgacctgctgggaatcaacctgaaggtcatgaaatcggttggcgaaggcattgctgcccacgcaccagacgcattcgttatctgnatcaccaacccgctggacgcgatggtttgggcgctgcgcgaattctccggtctgccccaccacaaggtntgcggnatggccggtgtgcttgattcggcacgcttccgtcanttcctcgcgactgaattcaangtctccatgaaagacgtcactgccttcgttctgggcggccacggcgatacaatggtgcccctgacgcgctattccaccgttgcgggtatcccantgcctgatctggtgaaaatgggctggaccacacaggataagctggacgcgatcgttcagcggacccgtgatggcggtgccgaaatcgttggcctgttgaaaaccggttcggcnttctacgcgcctgcgacatcggcaatcgaaatggccgaagcctatctgaaagaccaaaaacgcgttctgccatgcgccgcctatgttgacggtgcctatggtctggacggcttctacgtcggcgtgcccaccgtgatcggtgctggtggcgtcgancgtgtggtcgagattgcgatgaacaaggacgaacagtccatgttcgacaactctgtgaacgccgttaaaggcttggtcgatgcgtgcaaaggcatcgatgaatcgctgaagtaataccctanggtgnagcgggcggnngtggtcgagatcacnntaaaccccgcccgctgcncctgcactttgctattggacgancccgcgggntgangccaaagccgctctctccccccgctcagatcagtctccgcagntagccaaanctgccgcgtcgcannttgaagacatgcgcatcatgcggcgcgnaaacgnacncttggggctgagttttcgcccaaacngtcgccgaaaagcccgatgaatttggttggctttngtncttgtgatcacagctggaaaattagtgatcacaaattnnggaaatgtccggcgctaaccgaagggtttgggcaactgcgccaataaaccgcttcaaattcacgcctctggacgtgacagtcccaaaaataccgttatctatgaccgcaacctgacgagaaaaggaatccatcatggcagatgtgaaccggggcaatcgcccgctgtcaccccacctgacgatctatcgcccgcaactgacctccatgacgtcgatcctgacgcggatcaccggcaacgcgatgctggtcgccgcgctgctgatcgtctggtggttcctcgcggcggcaacgtcggcggagtattttgatatcgcgaacggtttcatcaccagctggttcggtgatctggtcatgttcctgtcgctgctggggctgtggtatcacacgctggccggtatccggcacctgatctgggacaacggctatgcgctggatatcccgacggctgaaaagctgggctgggccgcgctgatcggttcagtcgttttgaccatcatcaccgcgctgatcatctgagggatagacacatggcttatttgacagaccgcaaacgcgctatgggcat

SEQ ID NO: 1626 - DNA, 4000 bp, Escherichia coli
  misc_feature (137)..(137): n is a, c, g, or t
  misc_feature (407)..(407): n is a, c, g, or t
  misc_feature (482)..(482): n is a, c, g, or t
  misc_feature (509)..(509): n is a, c, g, or t
  misc_feature (620)..(620): n is a, c, g, or t
  misc_feature (659)..(659): n is a, c, g, or t
  misc_feature (785)..(785): n is a, c, g, or t
  misc_feature (863)..(863): n is a, c, g, or t
  misc_feature (869)..(869): n is a, c, g, or t
  misc_feature (962)..(962): n is a, c, g, or t
  misc_feature (965)..(965): n is a, c, g, or t
  misc_feature (1028)..(1028): n is a, c, g, or t
  misc_feature (1040)..(1040): n is a, c, g, or t
  misc_feature (1043)..(1043): n is a, c, g, or t
  misc_feature (1100)..(1100): n is a, c, g, or t
  misc_feature (1115)..(1115): n is a, c, g, or t
  misc_feature (1145)..(1145): n is a, c, g, or t
  misc_feature (1256)..(1256): n is a, c, g, or t
  misc_feature (1397)..(1397): n is a, c, g, or t
  misc_feature (1556)..(1556): n is a, c, g, or t
  misc_feature (1670)..(1670): n is a, c, g, or t
  misc_feature (1844)..(1844): n is a, c, g, or t
  misc_feature (1868)..(1868): n is a, c, g, or t
  misc_feature (1988)..(1988): n is a, c, g, or t
  misc_feature (2441)..(2441): n is a, c, g, or t
  misc_feature (2443)..(2443): n is a, c, g, or t
  misc_feature (2466)..(2467): n is a, c, g, or t
  misc_feature (2470)..(2482): n is a, c, g, or t
  misc_feature (2484)..(2484): n is a, c, g, or t
  misc_feature (2490)..(2490): n is a, c, g, or t
  misc_feature (2495)..(2498): n is a, c, g, or t
  misc_feature (2500)..(2501): n is a, c, g, or t
  misc_feature (2503)..(2505): n is a, c, g, or t
  misc_feature (2507)..(2507): n is a, c, g, or t
  misc_feature (2509)..(2509): n is a, c, g, or t
  misc_feature (2511)..(2511): n is a, c, g, or t
  misc_feature (2516)..(2516): n is a, c, g, or t
  misc_feature (2518)..(2520): n is a, c, g, or t
  misc_feature (2524)..(2524): n is a, c, g, or t
  misc_feature (2526)..(2527): n is a, c, g, or t
  misc_feature (2533)..(2534): n is a, c, g, or t
  misc_feature (2542)..(2542): n is a, c, g, or t
  misc_feature (2544)..(2544): n is a, c, g, or t
  misc_feature (2546)..(2547): n is a, c, g, or t
  misc_feature (2553)..(2553): n is a, c, g, or t
  misc_feature (2564)..(2564): n is a, c, g, or t
  misc_feature (2569)..(2572): n is a, c, g, or t
  misc_feature (2608)..(2608): n is a, c, g, or t
  misc_feature (2614)..(2616): n is a, c, g, or t
  misc_feature (2628)..(2628): n is a, c, g, or t
  misc_feature (2632)..(2632): n is a, c, g, or t
  misc_feature (2641)..(2642): n is a, c, g, or t
  misc_feature (2645)..(2645): n is a, c, g, or t
  misc_feature (2649)..(2649): n is a, c, g, or t
  misc_feature (2653)..(2654): n is a, c, g, or t
  misc_feature (2662)..(2662): n is a, c, g, or t
  misc_feature (2666)..(2666): n is a, c, g, or t
  misc_feature (2675)..(2675): n is a, c, g, or t
  misc_feature (2681)..(2681): n is a, c, g, or t
  misc_feature (2689)..(2693): n is a, c, g, or t
  misc_feature (2695)..(2698): n is a, c, g, or t
  misc_feature (2700)..(2700): n is a, c, g, or t
  misc_feature (2702)..(2702): n is a, c, g, or t
  misc_feature (2704)..(2704): n is a, c, g, or t
  misc_feature (2707)..(2707): n is a, c, g, or t
  misc_feature (2712)..(2712): n is a, c, g, or t
  misc_feature (2715)..(2716): n is a, c, g, or t
  misc_feature (2719)..(2719): n is a, c, g, or t
  misc_feature (2722)..(2722): n is a, c, g, or t
  misc_feature (2727)..(2729): n is a, c, g, or t
  misc_feature (2735)..(2735): n is a, c, g, or t
  misc_feature (2739)..(2739): n is a, c, g, or t
  misc_feature (2741)..(2741): n is a, c, g, or t
  misc_feature (2756)..(2756): n is a, c, g, or t
  misc_feature (2760)..(2760): n is a, c, g, or t
  misc_feature (2767)..(2767): n is a, c, g, or t
  misc_feature (2769)..(2770): n is a, c, g, or t
  misc_feature (2772)..(2772): n is a, c, g, or t
  misc_feature (2776)..(2776): n is a, c, g, or t
  misc_feature (2784)..(2785): n is a, c, g, or t
  misc_feature (2788)..(2788): n is a, c, g, or t
  misc_feature (2793)..(2793): n is a, c, g, or t
  misc_feature (2797)..(2797): n is a, c, g, or t
  misc_feature (2800)..(2800): n is a, c, g, or t
  misc_feature (2802)..(2802): n is a, c, g, or t
  misc_feature (2806)..(2806): n is a, c, g, or t
  misc_feature (2811)..(2811): n is a, c, g, or t
  misc_feature (2817)..(2817): n is a, c, g, or t
  misc_feature (2824)..(2824): n is a, c, g, or t
  misc_feature (2826)..(2826): n is a, c, g, or t
  misc_feature (2831)..(2832): n is a, c, g, or t
  misc_feature (2834)..(2834): n is a, c, g, or t
  misc_feature (2836)..(2836): n is a, c, g, or t
  misc_feature (2838)..(2839): n is a, c, g, or t
  misc_feature (2841)..(2841): n is a, c, g, or t
  misc_feature (2844)..(2844): n is a, c, g, or t
  misc_feature (2850)..(2850): n is a, c, g, or t
  misc_feature (2853)..(2854): n is a, c, g, or t
  misc_feature (2858)..(2858): n is a, c, g, or t
  misc_feature (2861)..(2861): n is a, c, g, or t
  misc_feature (2863)..(2863): n is a, c, g, or t
  misc_feature (2866)..(2866): n is a, c, g, or t
  misc_feature (2870)..(2873): n is a, c, g, or t
  misc_feature (2884)..(2884): n is a, c, g, or t
  misc_feature (2886)..(2887): n is a, c, g, or t
  misc_feature (2891)..(2891): n is a, c, g, or t
  misc_feature (2893)..(2893): n is a, c, g, or t
  misc_feature (2896)..(2896): n is a, c, g, or t
  misc_feature (2899)..(2899): n is a, c, g, or t
  misc_feature (2901)..(2901): n is a, c, g, or t
  misc_feature (2903)..(2903): n is a, c, g, or t
  misc_feature (3061)..(3061): n is a, c, g, or t
  misc_feature (3694)..(3694): n is a, c, g, or t
  misc_feature (3865)..(3865): n is a, c, g, or t
  misc_feature (3949)..(3949): n is a, c, g, or t
gcagttccgatacttctacagaagtagtaccgataagcactgggcgaccagctaccgatagttctactactttgtcaattacagcgttgtatttctcgcgtttggttttatagataaggtcgttgtggtctttgcgngcaatagggcggttggttgggatttccattacatccaacttgtagatttcccaaaactcaccagcctcagtaatcgctgtacctgtcatacccgatagcttgctgtacatacggaagtagttttgcaaggtgatagtagcgtaggtttgggtagccgcttcaatcttcacattctctttagcctcaatcgcttggtgcaatccgtcagagtaacgtcttccgtccattatacgacctgtttgctcgtctacgataagtactttattatcnattactacatactctacatctttttcaaagagcgtgtaggcttttagcagctggttgagggtatgaatacgctcnctttttacgctgaagtctttaaaaagnttatctttaagcgcggcttcttcttcaataggcagttttttgttctctatttcagcaatttctacccctatatcaggaagtacaaagaaatctttatcaccatcgtaggcnatatcggcaaatcctttgtcggtaagttctatttggttntttttttcgtcaatcacgaagtacaattcggcatccacctttggcatttcgcgattgttatcctgcatatagtagttttcggttttctgtagcaattgttttacaccttcttcgctaaggaatttnataagggcattgtttttaggcagcccacggtgtacgcgcaataggaggaatcccccttctttagtatttccttcagcnataagnttgcgggcatcggcaagcactttagtaaggtaggtacgttgtttagctaccaaatcggctactataggtttaagttcgttgaactcgtgtaantcncctttaggagtaggtcctgaaatgataagcggcgtacgggcatcgtcaataagcaccgagtcnacctcatcgacnatngcgtagttgtgagcgcgttgcaccaagtcttcagaagtgtgcgccatattgtcgcgnaggtagtcaaaaccnaattcgttattagttccgtaagtaatatcngcgttataagcgttgcggcgagcggcagaattaggctggtgattgtcaatacaatctacacgcaaaccgtgaaactcaaatagaggtcccatccaagcactatcgcggcgngcaaggtagtcgttcacggttaccaagtgcaccccattgcctgtaagggcgttgaggtatacaggaagagtagccacgagagttttaccttcccctgtttgcatttcggcaattttaccttggtgaagtgctatccccccnataagttgcacatcgtaatgcaccatatcccaagtaacatcttttccagcggcgtcccaatggtttttccagatagctttatcgccatcaattgatacgtagtcgtgtgaggcagatagctcacgatcacgttcagtagctgttacggcaatagtctcnttgttagcaaagcggcgcgctgtttctttcatagtagcaaacgcttcaggcaaaatgtcgtttagcactttttccgaaacctgataagcctcctgacttagtttgtctatctcnacatagaggtcttccttagcgtctatgctatcagtagcgttagcctgctcttgtaaggtagcaattttgctatcaagagcggcgcgagcttcttttattttatttttaaactcaatggttttagctcgcagctcgtcattgctgatgttttcaagttgccctgcgtaagttttnattttttctactatgggctgaatngcttttaaatcgtttttggctttgtcgcctacgaatatttttattagggaattgataagactcatttatataattatgaattttgaattatgaattgtcaataaatataccaaagggggnggggctgacaaattgtcagtttgttttattattttgttaattaaaaaaagtctctcgttggagacttttttaatattcatcttcattccaaaggaaatcttcttcagaaggataatcaggccatatttcatcaatagattcatacatatcgccttcgtcttccatttcttgcagattttcaactacttccataggggctcctgtacggatagcatagtctataagttcgtctttggtagcaggccaaggtgcatcacttaggtgtgaagcgagttctaacgtccagtacataaagtttgtattttgaaaattttcggcaaaagtaatattttttattgagtatgcaaatttttcagaagatttttttgtttcttgccaaatctccctatgcgcaccccctgcccgtgcagcttacctacctttccgaaccttcagcgaaggttgagcgaaggntnagcgaaggataagcgaaggatannctnnnnnnnnnnnnnanatcaangaaannnnanngnnnananangtaanannnactnannaaaaanngtgtaatnanannataatngtatcttttantaagnnnnttataagaaagtcttaacatcgtaatttgttgatantaagtnnntttaaaaaatantttnctatttganntantttngcannattttttnatantaaaatatntaacgnttgatttnnnnntnnnnanantntanaatanatnnatnatnatttnnnaataanattngnataaaattaaaatantganaagaaantnntnaaanaaacattnntanataanaaancantnaaangaaanattctnaaaaaantnaattnnantntnntnttnggaaanaanncctntananaanattnnnnaagtttttaantnnttancnagncantnantgggacaactaacacgaagttagtagtagtatttatattatatgcattgagaaaggcttccttttttgtgaaaggaagtctttttttacgaatattgtgttttgtattgtttttttttgtacatttgcacgctttataaacttataaataattttatnatacaacaagcaattatgaaaaattccattcttttagtggaggacgatatagttttctcaaagatgctaagtcgttttttagaacgtaatggttatgatgtaatagggtgttatacgctagaagaagcgggaaaaaaccttgatatgtcaataaaaatggtttttacagaccttagattacccgatggagatggtatcagcttcctcaaacgtgtaaaaaacgcttaccctacaatgcctgtagtggtaatgacaagttatgccgaagtatctacagcggtagaagctatgaaattaggagcttttgattatatatcgaaaccttttcagcaagaagacgtgctgaatgtaataaaaaacgcccaaaatagtatgcacaatatagctacagcgggcactatttttactgaaaaaccagccgataatagcgtacctgctaaagtagccaaactacctgttatagatgacgataacccttatatagaaggggtaagtgccgcttctaaaaagttaagcaagtttatcaacctcgtagcgcccaccgatatgtctgttttgataatgggtgaaagtggtacaggtaaagaagtggttgcaaaatctatccatatgaagagtagccgccgcaataanccttttataccggtagattgtggtgctattcctaaagaaatagcagcaagtgagttctttggacacgtaaaaggttcgtttacaggggctattaccgataaaaaaggtcattttgaggaggctaatggcggtactatcttccttgatgaagtgggtaacctaagctatganaaccaaatacagctactgcgcgctttgcaagaacgccgtataaaaccaataggtagctctaaagaaatagaagtagatatcagngtgttggcagctaccaatgaagatttgttggaggctgtgaaaaaaggcgaa

SEQ ID NO: 1627 - DNA, 4000 bp, Escherichia coli
  misc_feature (160)..(160): n is a, c, g, or t
  misc_feature (2663)..(2663): n is a, c, g, or t
  misc_feature (3610)..(3610): n is a, c, g, or t
  misc_feature (3613)..(3613): n is a, c, g, or t
  misc_feature (3714)..(3714): n is a, c, g, or t
  misc_feature (3809)..(3809): n is a, c, g, or t
  misc_feature (3860)..(3860): n is a, c, g, or t
aatagagacacgttccatacatgcatcatcatcacttacatctatgataggagaatgtggtttacatttttacaaagttggaaaaattgcaactataatgagtgaaatgaaatcactcacatatccatactacataatttataaaaatatcatagaaggnaatcacacagtactattattagaatataatcaaaacaaagattttttcttagatcctaaggatgcactaaaggaattactagaaacagaagaaggtcaaggaagaaaagttctcacagaatcaagttatgccattgtcgcttcaagaattggttttaaggatcagacaataatttcaggcaaattatccagtctagcacaaacagattttggaaaaccaccacatacagtaatcattccaggtagattacattttacagaatcagatgcattaagattatttggtcagtgtatagatgagccatttgataattcggaaaaaacagaaaaaatttcaaagcaaatgatggaaaaatatgttcccatggtaagagaagctcttgaagaaattataccatattataaaaatcaaaaagaatttgaagtaattttagataatgcagaacgatatattgatcaggcagagatatttctagctgaaggtcgagacgaaaatgcaattttgagtatagggtatgctgatggactagttgatgcattaagattggcaaaaggccttgaatttaaaatgtaaaattatcaataaattaaagagtgggtcaaggattagaaaaaatattggaattaatagaaaaaataatactctcaataatgtatgtgtcccaaattaatggaaaattaccaatagagtcaatcaaagaaaaaactatgttttctgaggaacaaattaaagaagaaattagtaaattaatagaaaaaaatttggttaatgaggatcaaataacactaaccgaaatgggaagagattcaattcacatagtactagcaggtggtgtttttgacatcattcatccaggtcacatttccacattaaatgcagcaaaagcattaggagatgtactagtagtggtggtagcaactgacaatacagcagttaaaatgaaaaaacgaagaccaattcacagtcaagaacaaagacaagaattagttaatgcattagcagtagttgatctgtgtttgataggccaagaaaatgatatttttaaaacagtaaatctagtaaaaccacaaattattgcattaggttatgatcagatccatcaagaacaatacattacagaaggatgtaaaaaaataaaacttgatgcaaaagttgctagattacaatcaccaattcctgaaagctctagttctaaaatagaaaaagagtatggagaatcaattcacggcatttaagaatcaattacaatttttattgaaacttttgaaccatcttttaatttagcatttttacgtaaacatgttttagaaattaattcaattacagaatcgtcatgatgagtacgttcaagtattattaattgacaattaatagaattattcagtttagctggaaaacatttcacccagccatatgttctcttaccatcagaaaaacttttaattttaatgccatctaaagtttcaaattgtttaatagattcttgatgaatttttttatccaatctaacattcaaagtaccaggaaatggaacatatccaattttagatatgaattgttttgtgtatccctttaatcccatgtaatatgcaccttcacccattcccgaaaccaaagtacctttaagatcaactgaggatggagaagaatctaaactcttttgtaaaatagatgacagtttcaccatttcagaaaatcccttacttgtaatttttacagataaatttcttccactaattattctagtgatgaatttattttgctctaattcaagtaaatgtttagacgcagcttgttgtgatttatgaatattttttcccaaagaagaagtagtaatactaacaaaattgtattttgctcctttagataacaggtaggagagagttaagaggtgctgaatttttagttcagtcatctaaaatcctaagatacgcctaaatcagcaaatgtcttaagagtcataccatcagagttagacaattttgcaactctgtgtccaactacacattcaattccagcattttttgctccttccaataatcgctttgtgataattccatccaataggaggtatttgattccagattgagatgatagtttgctaactacttcgctaattggaactttaaaaatttcattttgatcaccatctaatgcaacagcttctaaagtttcattaagattagggaaaattttggaagctacatctgcaatagatttgtcatcttcactgttgagttttggtgcaggtttaccatttttaatttcatcagcaataggttctaaaatttcgcttaatctttgaggagttaactcttctacttcaacaccggtatctgcttgtaattcataatcaagtgtaacaactgattttaattctttaagaataaatccgcctgctctatctccatcgatgaaagcaacaacagtatctttttcagagcataattctttaattgattcatcaatttttgcaccttcaattgcaagaacattatcatanccagctcttaaaagattgataacatcagctctaccttcaactaaaattatccattttgaattaaacactccagaactgcaagttaattttgatggtccatatgtagatagtttaccagaatcaccttgatgaacatcatttaacatggtttcaccttcactaacagtttttgttgcccatttttgtttaatttcttttgcacgtcttacaatatcatctttctttgcagcacgtacatcatcaattgcatctaaagtaaatttacaatcaaatggaccaactttatcaatactttctatacctgctgcaatcaatgcgcaagtatcaatatcagtactcataggaattacagcatttccatttgtagtattagatgtagatttagcaataacttcaatacgtcctacttttgaaactcgttgcagttcattcaggttcatctctgggcctaacagtccttctgtttggccaaaaatggcgccgattatatctgctcgttcaacgagtccatcaacttcgtaggaaagtttaacgtgatatttgacaattcctgattgaggcatatactcttcatctcctttatcattatatcctggaatcctattctgcgatatatgagggtatcgaaaaatatgagatatagcaaacgctaatgaaattaaaaaatgaaaataatgatactagtttattcggtactaaatgagtgaccacaagaacaggattttgtaacatttggattgttaattttaaatccagaacccattaggctttcaatatagtcaacgtttgcaccttgtaaatgatcaacactgtagctatcaactaagagtttaactccattttcttcaagaactaaatcatcttcttctggtgctttttcaaagcccattccataagataatccagaacaacctccaccttgaacatatactcgtaagtattcaggngantcggcttcttctttcatgaattcatgaattttctcagctgcttttgcagtaactgtaaccattttttgtgtttgttcagttgccattatgatcaaaaatcnattttaaattataataagcttttccccaccaacatactagtaatacagtaggctcgataaataataaaaataaaaaagagactgaaatagcttantttttggatttatttacaaatgcagtcattcgttcttggcgatcaggatgngtaaagcaatttctccaagcaaggagttcaatagaaagaccagtatcaagatctgcatttcttcctttattgattgcaactttagacatctgaacacccatagttgaacatccagcgatttgttgtgccattttcaaagc

SEQ ID NO: 1628 - DNA, 4000 bp, Escherichia coli
  misc_feature (3)..(3): n is a, c, g, or t
  misc_feature (6)..(7): n is a, c, g, or t
  misc_feature (10)..(18): n is a, c, g, or t
  misc_feature (20)..(20): n is a, c, g, or t
  misc_feature (22)..(35): n is a, c, g, or t
  misc_feature (37)..(38): n is a, c, g, or t
  misc_feature (40)..(41): n is a, c, g, or t
  misc_feature (43)..(47): n is a, c, g, or t
  misc_feature (49)..(54): n is a, c, g, or t
  misc_feature (56)..(57): n is a, c, g, or t
  misc_feature (59)..(59): n is a, c, g, or t
  misc_feature (63)..(64): n is a, c, g, or t
  misc_feature (66)..(66): n is a, c, g, or t
  misc_feature (68)..(72): n is a, c, g, or t
  misc_feature (74)..(75): n is a, c, g, or t
  misc_feature (80)..(80): n is a, c, g, or t
  misc_feature (82)..(85): n is a, c, g, or t
  misc_feature (87)..(98): n is a, c, g, or t
  misc_feature (100)..(101): n is a, c, g, or t
  misc_feature (103)..(103): n is a, c, g, or t
  misc_feature (105)..(105): n is a, c, g, or t
  misc_feature (108)..(108): n is a, c, g, or t
  misc_feature (110)..(123): n is a, c, g, or t
  misc_feature (125)..(127): n is a, c, g, or t
  misc_feature (129)..(133): n is a, c, g, or t
  misc_feature (135)..(139): n is a, c, g, or t
  misc_feature (141)..(153): n is a, c, g, or t
  misc_feature (155)..(156): n is a, c, g, or t
  misc_feature (158)..(160): n is a, c, g, or t
  misc_feature (163)..(163): n is a, c, g, or t
  misc_feature (165)..(165): n is a, c, g, or t
  misc_feature (169)..(169): n is a, c, g, or t
  misc_feature (171)..(173): n is a, c, g, or t
  misc_feature (175)..(176): n is a, c, g, or t
  misc_feature (180)..(180): n is a, c, g, or t
  misc_feature (182)..(190): n is a, c, g, or t
  misc_feature (193)..(201): n is a, c, g, or t
  misc_feature (203)..(205): n is a, c, g, or t
  misc_feature (207)..(209): n is a, c, g, or t
  misc_feature (212)..(212): n is a, c, g, or t
  misc_feature (216)..(216): n is a, c, g, or t
  misc_feature (220)..(221): n is a, c, g, or t
  misc_feature (225)..(230): n is a, c, g, or t
  misc_feature (234)..(235): n is a, c, g, or t
  misc_feature (237)..(238): n is a, c, g, or t
  misc_feature (240)..(241): n is a, c, g, or t
  misc_feature (243)..(243): n is a, c, g, or t
  misc_feature (245)..(245): n is a, c, g, or t
  misc_feature (247)..(248): n is a, c, g, or t
  misc_feature (250)..(250): n is a, c, g, or t
  misc_feature (252)..(252): n is a, c, g, or t
  misc_feature (254)..(255): n is a, c, g, or t
  misc_feature (257)..(257): n is a, c, g, or t
  misc_feature (260)..(260): n is a, c, g, or t
  misc_feature (262)..(267): n is a, c, g, or t
  misc_feature (272)..(272): n is a, c, g, or t
  misc_feature (275)..(275): n is a, c, g, or t
  misc_feature (278)..(278): n is a, c, g, or t
  misc_feature (280)..(281): n is a, c, g, or t
  misc_feature (284)..(284): n is a, c, g, or t
  misc_feature (286)..(290): n is a, c, g, or t
  misc_feature (292)..(292): n is a, c, g, or t
  misc_feature (295)..(299): n is a, c, g, or t
  misc_feature (301)..(301): n is a, c, g, or t
  misc_feature (303)..(303): n is a, c, g, or t
  misc_feature (305)..(305): n is a, c, g, or t
  misc_feature (307)..(307): n is a, c, g, or t
  misc_feature (312)..(313): n is a, c, g, or t
  misc_feature (316)..(317): n is a, c, g, or t
  misc_feature (320)..(320): n is a, c, g, or t
  misc_feature (323)..(325): n is a, c, g, or t
  misc_feature (328)..(328): n is a, c, g, or t
  misc_feature (331)..(334): n is a, c, g, or t
  misc_feature (336)..(336): n is a, c, g, or t
  misc_feature (338)..(338): n is a, c, g, or t
  misc_feature (340)..(344): n is a, c, g, or t
  misc_feature (346)..(358): n is a, c, g, or t
  misc_feature (360)..(360): n is a, c, g, or t
  misc_feature (362)..(362): n is a, c, g, or t
  misc_feature (365)..(365): n is a, c, g, or t
  misc_feature (368)..(369): n is a, c, g, or t
  misc_feature (371)..(371): n is a, c, g, or t
  misc_feature (374)..(374): n is a, c, g, or t
  misc_feature (378)..(379): n is a, c, g, or t
  misc_feature (381)..(381): n is a, c, g, or t
  misc_feature (383)..(383): n is a, c, g, or t
  misc_feature (385)..(385): n is a, c, g, or t
  misc_feature (387)..(387): n is a, c, g, or t
  misc_feature (389)..(395): n is a, c, g, or t
  misc_feature (397)..(397): n is a, c, g, or t
  misc_feature (399)..(407): n is a, c, g, or t
  misc_feature (409)..(409): n is a, c, g, or t
  misc_feature (411)..(416): n is a, c, g, or t
  misc_feature (418)..(419): n is a, c, g, or t
  misc_feature (483)..(483): n is a, c, g, or t
  misc_feature (510)..(510): n is a, c, g, or t
  misc_feature (525)..(525): n is a, c, g, or t
  misc_feature (570)..(570): n is a, c, g, or t
  misc_feature (572)..(572): n is a, c, g, or t
  misc_feature (577)..(577): n is a, c, g, or t
  misc_feature (601)..(601): n is a, c, g, or t
  misc_feature (606)..(606): n is a, c, g, or t
  misc_feature (616)..(616): n is a, c, g, or t
  misc_feature (618)..(618): n is a, c, g, or t
  misc_feature (639)..(639): n is a, c, g, or t
  misc_feature (663)..(663): n is a, c, g, or t
  misc_feature (687)..(687): n is a, c, g, or t
  misc_feature (690)..(690): n is a, c, g, or t
  misc_feature (699)..(699): n is a, c, g, or t
  misc_feature (702)..(702): n is a, c, g, or t
  misc_feature (735)..(735): n is a, c, g, or t
  misc_feature (792)..(792): n is a, c, g, or t
  misc_feature (849)..(849): n is a, c, g, or t
  misc_feature (851)..(852): n is a, c, g, or t
  misc_feature (1043)..(1043): n is a, c, g, or t
  misc_feature (1109)..(1109): n is a, c, g, or t
  misc_feature (1265)..(1265): n is a, c, g, or t
  misc_feature (1304)..(1304): n is a, c, g, or t
  misc_feature (1307)..(1307): n is a, c, g, or t
  misc_feature (1322)..(1322): n is a, c, g, or t
  misc_feature (1442)..(1442): n is a, c, g, or t
  misc_feature (1499)..(1499): n is a, c, g, or t
  misc_feature (1589)..(1589): n is a, c, g, or t
  misc_feature (1847)..(1847): n is a, c, g, or t
  misc_feature (1985)..(1985): n is a, c, g, or t
  misc_feature (1991)..(1991): n is a, c, g, or t
  misc_feature (2371)..(2371): n is a, c, g, or t
  misc_feature (2389)..(2389): n is a, c, g, or t
  misc_feature (2605)..(2605): n is a, c, g, or t
  misc_feature (2806)..(2806): n is a, c, g, or t
  misc_feature (2926)..(2926): n is a, c, g, or t
  misc_feature (2986)..(2986): n is a, c, g, or t
  misc_feature (3031)..(3031): n is a, c, g, or t
  misc_feature (3094)..(3094): n is a, c, g, or t
  misc_feature (3118)..(3118): n is a, c, g, or t
  misc_feature (3235)..(3235): n is a, c, g, or t
  misc_feature (3334)..(3334): n is a, c, g, or t
  misc_feature (3391)..(3391): n is a, c, g, or t
  misc_feature (3433)..(3433): n is a, c, g, or t
  misc_feature (3487)..(3487): n is a, c, g, or t
  misc_feature (3541)..(3541): n is a, c, g, or t
  misc_feature (3568)..(3568): n is a, c, g, or t
  misc_feature (3598)..(3598): n is a, c, g, or t
  misc_feature (3601)..(3601): n is a, c, g, or t
  misc_feature (3715)..(3715): n is a, c, g, or t
  misc_feature (3736)..(3736): n is a, c, g, or t
  misc_feature (3763)..(3763): n is a, c, g, or t
  misc_feature (3814)..(3814): n is a, c, g, or t
  misc_feature (3859)..(3859): n is a, c, g, or t
  misc_feature (3931)..(3931): n is a, c, g, or t
  misc_feature (3973)..(3973): n is a, c, g, or t
  misc_feature (3976)..(3976): n is a, c, g, or t
ggnggnnaannnnnnnnncngnnnnnnnnnnnnnngnnanngnnnnngnnnnnntnnanaaannangnnnnntnnttttntnnnncnnnnnnnnnnnncnngntnaangnnnnnnnnnnnnnncnnncnnnnnannnnnannnnnnnnnnnnntnncnnnttnancccngnnnannaaantnnnnnnnnnaannnnnnnnnannngnnnaantttntttnnaaannnnnnaggnnanntnnantngnnangntnntnaantnnnnnnaaaanaanaantnnaancnnnnntnttnnnnngntngntnttttnnttnnttnaannnaanaannnncngngnnnnnannnnnnnnnnnnnananaanaannantgntttnncnantngncnnnnnnngncnnnnnnnnntnannnnnncnnagggaggcaacacatgattacaggtatccagattactaaagctgcaaatgacgatctgctcaantctttctggctgctggacagcgagaanaacgaagcgcgctgngtcgttgcgaaagcgggttttgctgaagatgaaatcgtgccggtnancaaantgggcgaaatcgaataccgtgaanttccnatggaagtgnanccggaagtgcgcgtggaaggnggtcagcacctgaacgtaaacgtnctgcgccgcgaaacgctgatggangcngttgagcanccngaaaaatacccacagctgactatccgcgtgtcnggctatgcggttcgctttaactcactgactccagaacagcagcgcgacgttatcgcncgtacctttactgaaagcctgtaacggcttcagcaggggggaataaaaaagccgggnanntccccggctttttttactcttcagttttcgtctctggtgcggcagagcttggcttacggcgcttaccaatatttttggtatcgcggtggcgctgcttcacgcgcggtttctctttttctttctcttttctctcagcacgtttcgcgagcgctttcttggacggtttacccgtcatcttttcactcggcgcncgcgtggtcgggcggagttcgtcaataacgcgcgctttcagcggctcatcaacatagcggccaatnttctgcagcagcaggtagtcatgcgcttcgaccagtgaaatcgcaatccctttgcggcccgcgcggccggtacggccaatacggtgcaggtaggtatctccgctgcgcggcatatcgaagttaatgacgtggctgacgtccgggatgtcgatcccncgtgcggcaacgtcagtcgcaaccagcacgttaacgcgnccntcggtcaggcgcttnatgccttcggtacgcttgatctgcgccatctcgccttcaagatagcagttgttgatcccggcgttacgcagcatttcagccagctcgtgcacgcgctcgcgcttacgcacaaacacgatngtgcgcagagcatcttcctgcttcagcaggtgtttcagcaattcgaccttgtgctcnaggttgtccgcgcggtagtaccactggtggatcttcttacgctcacgggtggacggcgtcgccgagacttccaccggatcttccagcagncgctctgcgaagtctttgatcgcttccccttcgagggtggcagagaacagcatcgtctggttacgccagcgcgtttccccggcaatgtgctcgatatcctgtgcgaagcccatgtccagcatgcggtcggcttcgtcgaggatcagcgtttcaaccgcgcggcagtcgaagttctcttctttaatgtactgcagcaggcgtcccgtcgtcgcaacgacgatgtcctggttttcgctgaacacttcggcgtggttcatntacgcaacgccgccggtgatggtggcgatatccagatgagtatttgccgcgagttcacgcgcgtgatcggcaacctgcattgccagttcgcgcgtaggcgtcaggattaaaatacgcggcgggccagattttttacgnggaaantcgagcagatgctgcaacacaggcagcaaataggctgctgtcttccccgtgccggttggcgcagaaccgagcacatcgcggccctcaagcgcaggcggaatggccgctgcctgaatggcggtcgggcgtgtaaagcctttgctctcaagtgcattgagcaggctttcatcgagttcaagttcggaaaaagtcgttacagtcatgttctacctctgtgtggggcgctgattatagacgttacggctgtaatcttcatctgtttgtatggatatcgcttttcggccacttcgctttcccctatgctactccagtttcacttagaaggttgccctgacatgtctcaactcaaagcgcagctgcgccgcgatggttttacgttnaaacaattttttgtcgcncacgatcgctgtgccatgaaagtcggtacagacggtattttactgggagcgtgggcgcctgtcgcaggtgttaagcgtattcttgatatcggtaccggcagcgggctggtggcgttgatgctggcgcagcgtacggaagaacatgtcaccattgatgccgtcgaactggatgcgcaggccgcagagcaggcgagtgacaatatggccgaatctccntgggcagcccgaatgaaggtggaatgcgcagatgtgctcgcctgggcgcctgaacaaaccgcgcgttacgatctgatcgtcagcaaccctccctactacgagcccggcgttgagtgcgggacacccgagcgtgaacaggcgcgttataccggctccctcgatcataaagcgctgctcaccagtgcggcagaactcatctcngaagaaggttttttctgtgtggtcctgcctgagagtaccggcaacacgttcatcggtatcgcgcaggagatcggctggacgttacgtctgcgtaccgatatttcggatacggaaggacgnctgccgcaccgcgtgctgctggcgctctcgccaaaagagggtgaatgctttaatgaccgnatggtgatccgtgggccagaccagcgttattccgaagattacacngctctgacccaggcattttatctgtttatgtaaacctgcggggcgagtatcgacgggccggantcagcaagctgatccgggtagtcnagggtatagtgcagcccgcggctctctttacgcatcatcgcgcagcgaacaatcagctcggcaacctgcaccagattgcgcagctccagcaggttattggatacgcggaaattggcntagtactcatcaatttcctgctgcagcatggtgatgcggcgcaaggcgcgttccaggcgtttcgtggtgcgcacaatccccacgtagtcccacataaanagccgtagctcatgccagttgtgctggatcacgaccagctcgtccgggttatccacncggctttcatcccaggctggcaggtgctctgtctcgcgggcntaaggcatgcgcttcgtgatgtcttccgctgctgaccagccgtacaccagacantcaagcagcgagttagaggccatacggttcgcgccgtgaagtccggtatagctnacctcaccgatagcatacagaccgtcnacatcggtacgtccatgatcgtcaaccatnacnccaccgcaggtatagtgggccgctggcacaatgggcaccggatcgcgcgttaaatcaatgccaagattgagcagcttttcgtaaatcatcgggaaatgctggcgaatgaactcngctggcttatggctgatatcnagatacatgcagtccacgccaagacgnttcatttcatgatcgatggcgcgggcaacgatatcgcgcggggccagttcnccccgggcgtcaaagtcgggcataaagcgggagccgtcagggcgnttcagataagcgccttcaccgcgcagggcttccgtcagcaggaagttgcgcgcctgagggtggaacagggcngttgggtgaaactgattaaactcgaggttcgccacccggcanccngcgcgccaggccatcgcgataccg

SEQ ID NO: 1629 - DNA, 4000 bp, Escherichia coli
  misc_feature (578)..(578): n is a, c, g, or t
ccaaaatacggaatgatgtgttgctccatcatatatcgtttgttcttcatggtgcgttccttcagctcattctgcttatcttcaaaataaacttccataaattcacttagcttcatatccatacttctgctgttattcaatttcttctgtcgctcatactcaagagcctctcgctttgtctcaaaacctctttttcttcgctttttcttttcacccctggcatttgtttcaaaccattgggctgtccatttcttagtgtctttttctttgtatgccatactgctctcctttcctatcctactgataattcgtagccatacatttttttcgcccaatacgctcttggaattcttccagccattgtgatatatccttgcgaagccaactcttcattcatgctttttaccagcttgtacgcatgagatttggaacaattcaattctcgggctacatcatcggcactcatcatatattgataattcgccatacattcgtcctcccttctatactttgaatctcgttacatttctagtatttgttttgtgtatgattttcgtacattcatattatcactacanatttcccttgtcaagatttcgtaattatatttttacgatattcgtatatgctatttttgaaaattattcttttatgtctttcgtatttgtgctatgataataattatatttatgcaattcgtaaattttaaatttatgaaaacaggaggtttcaatgggagacggtaagaaactgaaagaaatattagacagtaaaggcacgaatgtccgccagattgcaaaagcaactggtatcagtgccacaacactttattcaattattcaaaaggattctaatatccgatttgactttgcacttagactggcaaatgaattagaaattgacgtgaatgagatatgctctgccagtcccttttcgggtgcaatcacagaagaagaaatatatcctacattaccgaatggattgaatggcgctcttgacggaaatcgggtaaaaacgtatttaaaaaattccatgtacccgcttatgtatcttttcgggaaaaacagtatgcctgatgtggataatttgctgacttccttttaccagttggatgatgaagctaggaaagaagtggtggaaacgatacaattcaagctgcagtatcacagagatcccgaacgggcagaacagattaaacagattaagggatggtaaaaataactccagtgaatcgttgaattcactggagttattgcctaatgatcaatatcctgtcttttgacaatcttcaagtagtttctctttaaatcatttactgagccaaagaatatttgctctgatttcgaaaaggaatgattctgtatttttagctttaacagttcaaaagtgcatatcatatcagccacctgaaacaacctataatccgatggttttacttttcgaaactccactcttggcaaaaatgcattaaacaaggtcgataatattttgtttaactctacttgtccattatcatagtatattttaaccaagtcgaacgaaagcaagaagtcatagtgctccctaataaaaacagatatttgctttgaaagtttacccgttgcttcaacaatatcttcaatatgctttttctctatatggaaagctttatattttaccccactctgtctcataaacgtaaccatcttattaaatatctttctacgttctatataatccatttcagagtattcttcctcttttcgaataatagggcctgtatgtatacaatgattttctaatcccaaaagtgataattctctatttaaatattccattggctcttgaatggatgcttcttgttcatgaaataccattgtaactatataccaaggagaatgataatcatattcaccaaaatccccagactcatcaataaaaatacttagttctttcatatagcgccttcttacttcaaattctgtaaaaaaaatggcggggatatacccgccaataatggggaacctccccatccgctgatggacccgggtctttcgaccagcccaaactgtaatgcattacagctttattctatgcacattatatcacgtctattcataattttcaaggtcaatctcatgctttctgtttggtaatttaagctttccgaaatattataccataatatctccgaatatatcaaaaatcgacatctgtccatctgactttttttgtgacatataattccatatagttttatctaacacactttcacccacttctaatacagatgcagtctttcgcaatattctacttgcttccttataatcggctgtcaaaacacctgctatttcaagaaattgaaacatatgcctgtcaatcggaatcgcttgctgaccagatagtaatttcatataatcaatagtctttcttcctactccattaatttctaataagctctccgcattcccatcatccaaaatccactccgccaaatcatcttctgtatttatattacaattatacaaatacaaagccaaattacagattgtgttttgctttcttttatttttccattgtattatttcctcaattggtattgtctgaaatagtattataaaatcacatgttgtcctataatccgaatatttgctcagaatattataaactcttggatacaccacacttttgtaattcattcctgcttgcaatactgaatctgtcaatgttgctgccatattataatatggtgttctttgtgtaatttcagcataattatggggaattctttccaaaaggtctataaccttttgaactgagttatctatattatccattaatcttttcctctagtatattatttatcgcattaatgcgatcaacacagtttggacacgctccacatggcatatctgaatttacctgacatgaatacgttatctcaataggagcatttagttctaatcctaactttgccacctctgtttttgtcatttcacgaaatggcatattaatcctaatagagccatattcatataacaaactttccaattttgtaaaaaattccatagaacaatctatctcttttgcatggttgctattaataaatgcggtatacacatcttttattcccatagattgcgcatatgcagatgccaatgaaataaacaaaatatttctatacgggagatacatatcctctgccacaacattatcttcccacaaattggcttctattatcattctcgaatttgattccttataaacatcaccaatttttataacacgcacattatctacatattcttcaggaagtacttgtaaaagtgtttgatattccttatccttacagtgttgaccgtaatcaataaataaaattactacatttttattttctttagcaagcttatatgccaaaacggtagaatccattccaccagaagcaagcaaaagacaatcaaaattattctccatttttcaccatcctactaaccacagtaaatactgcatcaattacttgactcttcgtcttgcaataatatgtacatgaattctttaaaaacatattatccagtttgagatacggatcataaagtattattggttttccatttgcttgataattcccgatttctaccaacgttccttggtcgttgtagagtaatgttgctatcattatcttgcattccgataacaattccatatctttagcaaatatagcacgttcttcattcatgtccatctctttattcacttgtccattttcttggattggtctccgaggtttaaaattatgatataaaagagaatcctctaaaatatccaatttctctgtatctacataatcaaaatctggagctgccatataaattggatagtttactctttcattccatggaactcttattccttccatttcaacaaaatcttcaatattctgaacaatgagctctacattttctttaaatttttcttgttgaattgtttgtgcatataaacttgacatccacgctgcaaatgc

SEQ ID NO: 1630 - DNA, 4000 bp, Escherichia coli
  misc_feature (716)..(716): n is a, c, g, or t
  misc_feature (1116)..(1116): n is a, c, g, or t
  misc_feature (1946)..(1946): n is a, c, g, or t
  misc_feature (1985)..(1985): n is a, c, g, or t
  misc_feature (1991)..(1991): n is a, c, g, or t
  misc_feature (1994)..(1994): n is a, c, g, or t
  misc_feature (2009)..(2009): n is a, c, g, or t
  misc_feature (2024)..(2024): n is a, c, g, or t
  misc_feature (2039)..(2039): n is a, c, g, or t
  misc_feature (2045)..(2045): n is a, c, g, or t
ctattattgggccgagaatggatgtaatggcgcctgatatgggtaccgatgagcaaaccatggcttggatcatggacacctacagcatgaaggtggggtatgcgtgcccggaaattgtaacagggaaacccgttgagctagggggttgtttagggcgcagagaagctactggacgaggtgttaccttttgtattttggaagcgctgaaggatctcaacattaaacctgaggaagctactgctgtggttcaggggtttggtaatgttggggcgatcacctgtgctgaactttctcaaaaagggattaaggttatagctgtttcggataggtatggcgcaattcataactcccttggcatcgatatcgttgagctgcaaaattttgtatcggcgggtaacttacttaaggacttccccaaagcaaagcagatcgatgcggatgaaatgctgatacttccctgcacggttttggtgcctgctgcacttgaaagagtgattcatgtaaagaatgctgcacagcttaagtgcaagatactagcagaagctgccaacggcccgactacccccgaggcggatgccatcattagtaaaagtgatatttatgtaatcccggacattttgtgtaatgcgggtggtgttacggtttcgtactttgaatgggtgcaggatattcagcaattgttatggagcgaagagcaggttaatcataaattatangagttgatgattaatgcattcaggcgggtgcgagatttggcgttgaacaagaaaatatcgatgaggttggcggctctatccttgggggtagagaaaatagcccgtgaaaagatcaaacggggcttgtttccctaaaatacttttagatcaatctggagagtttatgccggttcaaatttcccctgcaacccttaaagaatggctcgatcaggggcatagtatttatcttcttgatgtccgagaaccttgggaaaatcagttcgctgccattcctaatagcgttttggtatctttgggcgacctttccaatagtttggatgaggtaacacctcctaaagatgctaaagttgttgtttattgccatcatggggttcgaagcttatctggggctgcaattctngaaaatgcaggcataacccctgcttattcacttgctggcggcattgaggcttggtcttgtgaaattgatccaaatattcccagatatcgctaaaaaaggggcaaatatggcttctttaagtcattttgatgatcagggcgccagcagaatggtggatacttcgaataaagaggaaacccaacgccttgctagggctagtgccattgttcgaatggaagaatctacggccgagttaatccggaacaaagagctttccaagggcgatgttttagaggttgcaaggttagcgggcattcaggctgccaagaaaacttgggatctcattcctctatgccatcccttggcaattacgggtgtaaaacttgatttctcgttttttgagaaaaacttgcttagaataactgcagtggtaaaagtatttggcaggacaggggtcgaaatggaagcccttacggctgttagtgttgctgcccttacggtttatgatatgtgtaaatctgtggataaagttatgaccattacggaaatccggttagatgaaaagactggtggaaagagcggttcatttgtcaggcaataatgacaaaccgcattccgatctccatgaaatgggccataatatgaacgcctcattgatgtactccacattttttactcccgaacgatatgactcaatgctcccgattcgttcagaccttgaacaagtcgaacgcattatctcgcgcgagcttatttctaggcataaagaattcaccgacatccttgatcatgtgagtcaatacaaaggcaaaaggcttcgccctgctctccttcttgcttgtgctcatgcntgtggtttagtcaatgaaagccattgggttttgggcgcngctgtnganctgattcatacagcntccttggttcatgangatgttttggattcngctcanatgcgcaggcatttgcccgctgttcataccctttggggaaccaaatctgctgttttgcttggagattgccttttcactaacgccttccaaatgactagtaatttagaaaacaaccgtgcttgcaaggttattggtagaagtgcccaccggatttgcgagggcgaacttttgcaaagctttcattcgggtgatattaacatcactgaagccacctaccttgatatcattgatggcaaaaccgcagaaatgatttctgcaagttgtgaattaggtgctgcttacgctggggcgagtgaagcggtgattgaatctatggctagttttggtcgtaatctgggcatggcttttcaaatcgctgatgatattcttgatcttgttggccatgaaaatcaaacaggcaaatctcttggcaccgacctcgatcagaaaaaacttactttgccactcatatggcttttgcaaaatggccctaatgtagaaaagaataagattaaaagtttgcttgagaaagattctaccgcacagagagtccagataaaaaagcttcttagtgattctggtgcaattgattacgccaagaacaaggcggaacaatttattgcatctggcaagagggatttacaggcacttgctccttcggcattcagaaacattctgcatcttatcacagatcagatactaaaccgttcctgctaattgcaatttatagtcaatgatatgtcgaagagttcgcttaatttaagtggattctttgagttcatttatttgaggttatgccaaacatagaggttttccactttcttgcgggcccactcggttttacgcagaaacttaaggctcgatttaatgcttggatcgtgcgtgaagcaattaatggtgatacggctaccaagttcttgccagccataatattcaaccaactcggtcagaattttctcgagcgtgattccgtgcagcggattgttttgctggtaattatccattttgtacatgaatccgaatcattcgactattgggaacataaacacccgctttatcagggtcggggataacccattcctaattatatgttttgcgggcatttatccaaaagatactgcggaagtgcgatggattgtgaaaacataaatcaatcgattgctgcgaacctccaggttgggacgctgggtgggtatacaccgttataaaaggcttcggttccaatagattctaataccttcttaagggcatgcctgcgaaccgttatgtagtaatactcacatcgtgaatccctaatgtaatcccaaacttggtagagttgatcggtttctttaataactgcatgaagatcttcaccaaatgcaggctcgagattcactcttgcgctaaggtgatgcctataagcacggttgaaccctagcatttcttggatgactaagcgatcagggaatcgcatggaatcaaacaccaaaggggcatcatatagctcgttgtagcgttttttaaggagttttacatccgattgaaaatcagatgacctaagcaaaatgtattggtgttcacgcggatctagaatttcgaagtttaaggcgattgcctgaacgaatggagagagatcagcttcgtcttgaattgatttctcggagtctgacatttctaatggggataataacaacattcctgcgagtatgaactctgatagtgccatgactgtttctcctcatgaaagttaccggaatggaacaaaacatgaaccgagatcaatgctggcctacttaattataggtaggctacgggacgttttttcacctgctttacaacgaaatctttatttttgaacctgactaaaactaaatcctgatatctaatcagcaaagttaatgccaaacctttaattctttaaaatcgaagattattggttcagaattgacctataaacgccatatacctgattccaaacctactttttagtgctt

SEQ ID NO: 1631 - DNA, 4000 bp, Escherichia coli
  misc_feature (746)..(746): n is a, c, g, or t
  misc_feature (814)..(814): n is a, c, g, or t
  misc_feature (826)..(827): n is a, c, g, or t
  misc_feature (835)..(836): n is a, c, g, or t
  misc_feature (845)..(846): n is a, c, g, or t
  misc_feature (875)..(875): n is a, c, g, or t
  misc_feature (878)..(878): n is a, c, g, or t
  misc_feature (884)..(886): n is a, c, g, or t
  misc_feature (892)..(892): n is a, c, g, or t
  misc_feature (1136)..(1137): n is a, c, g, or t
  misc_feature (1140)..(1140): n is a, c, g, or t
  misc_feature (1146)..(1146): n is a, c, g, or t
  misc_feature (1255)..(1255): n is a, c, g, or t
  misc_feature (1275)..(1275): n is a, c, g, or t
  misc_feature (1286)..(1286): n is a, c, g, or t
  misc_feature (1589)..(1589): n is a, c, g, or t
  misc_feature (1592)..(1593): n is a, c, g, or t
  misc_feature (1596)..(1597): n is a, c, g, or t
  misc_feature (1771)..(1771): n is a, c, g, or t
  misc_feature (1988)..(1989): n is a, c, g, or t
  misc_feature (3152)..(3152): n is a, c, g, or t
tgacaagtagcaatttcccttgtccaatcaattgaaagccctatagactttaattgcgacctcattaaattgatgttttgataagtccattctgacggtgatttttttgcaacgattgcagcattttctgcaggaagaccaaatgcatcccaacccattggatgcataacattaaatccacacatttttttataccgggccaccacatctcccaaggcatagtttctaacgtgtcccatatgaattttacccgaaggatatggaaacatttccaatacataatatttctttttgtttttatctgttgctgtttgaaaaattttttctttttcccatttctgttgccacaagcgctcaacttttttatggttgtatcttgatgacacgttgctaactttgagagagtcttattttttttgctttgttcagaatagcgttttcaagctttgcatcattatcaatattattttttatgtctacccattggccatttgacaatgattggcaaaaagagttgacttttaaattatcagtcttcatttcatatcccttaataaatatatttatcttacatctttcgttaggggcgccttggttggcataccaatcagtgattattatacccgcaaaaggatccacagaagcaagaggcataaaatctatagtctccaaacttcctttccacaagtatggattaatgggcaatccaacggaggtagttgttgttttttcagacttattaatcncacccaaagacaaaccttttttgccaagcaagccaccaccggactttaatctgttttctgcgtcagcnagcgccaattgnngttcttcnngagtgccgnnaggaaaggttgtgcccgatcttttgattnttncacctnnngtttgngcctctaattcagaggtatcaattcccctggtttcattacaagatgttaagaggaaagaaaggatgggaagcaggaaaatcaaaataagctttctattcataatagacaagtattccaatcaagtgaaaaaataaacaaaaaaaaagcggcttatttgaagccgcttttataatagaataaaaaattataggttattagaagcttacagtagccccaacataccaagatgagccactaaatgcnnccncagatncaccttcatcatttgagtcttggtttctgtatccaactgttccagtaacgcctgaagctataacataatcaacacttgctccaattacgtccactgagtcttcagcgcntgttgcgttggtgccaagancttcatctttngcatcaccactagttgcgccaacattaaacgtaatgtcgccagatacatattttgcacccacagatgcaaatgaaccctgcatttggttgttttctgcaacccagtcaccatccataaagcctgcaccgacagttaagtcgccagtttccacagttgcccctacatggtaaacagcgttatctttagtagcagattgactgttattagtagcatcgtggtaaccagcacccactgtcacggttgaatcacccgcagtagttacataagtaacacctaccgcataagcgttttcaagcgtaacngtnncannagcgccgcttgtttcagacacatcactattaaatgctgctgaaacattcgcactgaaaccttcaatgccaaaagcatctgccgcagttgcataatcaaatccaaccttatcagaagatgcgccagttgttaaagcaccagctgaattgttacttgaagtgttagtaattcccanttcgccgccaccaccaggaacggaaacagcgtgtgccgctgatgctgaacctgcttcaattaattgtagtgatgatccgtcagtgaaagtcaatgttaaaccacttgcatctgattcagctccaccttcatcagttagagtgaagccagtagcaatttttacccctgcatcagtagtctcagaaatgctaacattgaagttagtcaattgtttttcnncaactgtatcactgtcagaggaatcaggattttctccttcaacaccaactctggtatgaccagagaaagttgccgaagcagcttccgcaacgccagcagcgcccatagttgaggcaagagcacttgctagtaatagttcttttttcataattactccttttgagttaatgaatattcattaatagtgaagaaaatatttcttcacttaaagacagatatacaataaattttttttctcgacaatttcagataaaaaatatatttttttttaaaaatgttgtaaatttacaacaaaatattattaagaaaatgggctttcaacatcaacaatacaaccaaattctatcatttataaataaaaattgcagaaaatcaataaatacacccaaaattatcgctatatcaaaaaatcacccgatatcaagcgtaagagaagccattgatagcggtgttaggatctttggtgaaaataaagttcaagaagcgctttcaaaattcagtgatttaaagaaacagcacaattcaattgaattgcacttaacgggccctttacagacaaacaaggtaaaatcagcattatctatatttgatatatttcaaacactggatagggaaaaattagcgattgaatttaataagcgtatggtaagggattcagataagaaatttttcattcaagtgaacacaggaaacgaaaaacaaaaaacaggcgtacacttagcatcttcgtctgatttcatagatttctgtcagcaagatttaaacttgtcaattattggattaatgtgcatgccgccaataaatgatgatcccacgaaacattttaccattctgaaaaatttagctgagaaaaaaaacttacagttcttaagtatgggtatgagcgcagattataaaaaagccttaatcctcggagccactcatataagaatcggaactttgttgttcggaagcagatagattatgaaaattgatgtagcaattatgaatgacaaccaagaatcagagatctgcagatttatcagcgctataaatgaattcaatatttttttaaaaccgattgaagatattgacaataaaacaaacggacttacaatcattattgttaacaaaaaagaagatgaaaaacaaattaaggatttaaaaaaattactagcacgcgnacgtactaactttatttttttaattccatcttcattaaaatcaatatcaaaagcaaccaataataagattgtttattttccaataaacataattgattttgaaaaagaaatttcaaaacacacaaacaatatgaccataaagtttggttgcttcagtttgaccaaccaaaatcttttatttgagaataacaatcagtacatatatttaacagaaccagaggcacatataattaaactactttttttgaataaattagttaaaaaaagtcaaattaaaagtgaggttttaaaattaagcgctgccgttgaaagcaaatctcttgaaactcacttgtatcgtttaagaaaaaaattatcaacattaagtcctaatatttcgattagatctgatgataaaaataatttagtaattactgagactaattgaataaggggttggcgagactaaacattttatcatccagagcagggttgtagttcgcatttacaatggcaaaactcgtgagaccctctgagttgttaatttcaatttttctaagctttattggtgatttttcaaaaataattttaatattattgatctcgtctttgatttttatttttttaataaaattaaaagaattattttcatcattaaacttaatatcttctaaaaattttttatcataaaaaaaatcaaaaaaaatttttgccacagtgtttttgggattgaaatattccacttcttttaaatcaagattataatacatagctttattatcttttataacaaagaccatttgtgttggcgcgctatactctattctcaatctgtttttttttaaaaaaaattcaccttcttgaagagc

SEQ ID NO: 1632 - DNA, 4000 bp, Escherichia coli
  misc_feature (154)..(155): n is a, c, g, or t
  misc_feature (232)..(232): n is a, c, g, or t
  misc_feature (238)..(238): n is a, c, g, or t
  misc_feature (241)..(241): n is a, c, g, or t
  misc_feature (343)..(343): n is a, c, g, or t
  misc_feature (385)..(385): n is a, c, g, or t
  misc_feature (394)..(394): n is a, c, g, or t
  misc_feature (397)..(397): n is a, c, g, or t
  misc_feature (403)..(403): n is a, c, g, or t
  misc_feature (412)..(412): n is a, c, g, or t
  misc_feature (418)..(418): n is a, c, g, or t
  misc_feature (424)..(424): n is a, c, g, or t
  misc_feature (427)..(427): n is a, c, g, or t
  misc_feature (433)..(433): n is a, c, g, or t
  misc_feature (436)..(436): n is a, c, g, or t
  misc_feature (451)..(451): n is a, c, g, or t
  misc_feature (453)..(453): n is a, c, g, or t
  misc_feature (457)..(457): n is a, c, g, or t
  misc_feature (459)..(459): n is a, c, g, or t
  misc_feature (463)..(463): n is a, c, g, or t
  misc_feature (465)..(465): n is a, c, g, or t
  misc_feature (469)..(469): n is a, c, g, or t
  misc_feature (482)..(482): n is a, c, g, or t
  misc_feature (489)..(489): n is a, c, g, or t
  misc_feature (495)..(496): n is a, c, g, or t
  misc_feature (556)..(556): n is a, c, g, or t
  misc_feature (580)..(581): n is a, c, g, or t
  misc_feature (583)..(583): n is a, c, g, or t
  misc_feature (610)..(610): n is a, c, g, or t
  misc_feature (616)..(616): n is a, c, g, or t
  misc_feature (619)..(619): n is a, c, g, or t
  misc_feature (637)..(637): n is a, c, g, or t
  misc_feature (643)..(643): n is a, c, g, or t
  misc_feature (667)..(667): n is a, c, g, or t
  misc_feature (685)..(685): n is a, c, g, or t
  misc_feature (715)..(715): n is a, c, g, or t
  misc_feature (788)..(788): n is a, c, g, or t
  misc_feature (1261)..(1261): n is a, c, g, or t
  misc_feature (1513)..(1513): n is a, c, g, or t
  misc_feature (2611)..(2611): n is a, c, g, or t
  misc_feature (3442)..(3442): n is a, c, g, or t
  misc_feature (3444)..(3444): n is a, c, g, or t
  misc_feature (3454)..(3454): n is a, c, g, or t
  misc_feature (3507)..(3507): n is a, c, g, or t
  misc_feature (3519)..(3519): n is a, c, g, or t
  misc_feature (3549)..(3549): n is a, c, g, or t
ggctaagtctcctgcattatggatggtttttcctctcagggtcttgccaaaatagtaagatacatcagggaagaagtaaaaagctccttcagggagattggtcttgaatccttctatttcgttgagtaattcatgtactatatcccgacggtgnnggtactcgtctatcatatattgtattttgctcaagggagctttcagggcggtgatactagcgcgctgagctatacanttggcnccnctggtgatctgtccttgcatcttggcacaggccttggtaatccaagcgggagctcccatatatcccatgcgccaaccgggcatcgcaaaggccttggagagnccattaacagtaatagtacgctcatacatcccttctatttcngccatggangtntgttgncctatatanttaatntgttcntanatctcntcngaaaggaagaagatntnaggntntttncnaagnacttgggctaagncttctanctcttnncgagagtaaatggtaccactaggattgccaggggagctaagccataccattttggtacgnggagtgatagctgcttcaagctgnncnggagtaatcttgaagttgccttcaagngtagtnggnatatccacgggcactccnccagcnattttagtaatatcagaataactnacccaatagggggtaggnaggatgacctcatcaccagggttgatcatnactaaagcaacattcgagagacattgcttagcacctgttgatacaataatctgatcaggggtgtagttcaggnggttgtctttcttgaatttctcacagatgacttcttttagttccatgtagccatccacgggcgaatacttgttgtaattctgctcaatagcttcgatggctgcttgttttacaaagtcaggtaccgcaaaatcgggttcacccaagctaaggctgatgatgtccttcccctgtgcctttagttcacgagccttggcggccatggcaagggtggcggagagtgccatattatttacacgatcggataaaaactctttcataggtttgtcgaaatttagtaggatgcgttccaaaaaacaaaagtacgattttttttggcaagtaggtcaagaactattaaaaaaatttgcgtatctttttttttaagactacttttgtcctttctaacaaaaaaacatgaaagaaattgtacttattacaggtgcttcctctgggatagggaaggctactgcggagctcttggctaaggcaggntatatagtatatgggagtgcaaggaatcctcaagaagttctacaaggagttaccatgttggctatggatgtgcgagatactgcttctgtgcagcaagctatagctactattatgcagcgcgaaggacgtatagatatccttattaacaatgctggagtaggcatcacaggagctatagaggagactcctatagaggccttggagaatgcctttgagactaacttcttcggggctgtacgcaccattcaagcngtacttcctattatgcgaagtcagtgtaaaggaatggttatcaatattacttctattgcatcctacatgggcttgcctttcagaggggggtattcggcaagtaagggcgccctatccctgcttacagagacactacgtatggaaacacaacaatttggcatcaccttctgtaacttagctccaggtgatgtagctaccgatattgcttctcggcgctttcatactccagccatagagggttctccttacaaacaatatgccgaggcactgccactgatgaatgaggatgtagacaaaggaatgcctgctgaagccatagctcagaagattgtccaaatcataagaaaaaagaatcctaagggacactatgtaaagggaaaattcatagaacgactctctctgttgttaaaggccatattaccagctaagtgctttgagaaattgctcaaaaaacattataacctctaaggggtaagttgttaaaagtcaataggataaaagaattgttaataacttattagagtaagtatttttatatttcgtagaaaagccttatttttgccccatgaaaaccataggaatttcaaaatattatcacatctaccaaaagccaggagatcgccggttttatgtacagatgcctgaacagactttggagtttcgcttctgtgaactcttggagtttcgcggcaaagtacaggccatagacctctctgctcattttgactactctcagccaggtatagagatacttactttctgtggtggtaagtacctatgtgtattcactacagagcaaatagtagacttgcaaaagttgctttttgagatatttgaaggggtatctgagaaagaaatctttaccaaatatgtactattatgattgtggttacaggaggcacagggctggtaggagctcatttgctctatgaactactttgtgctggtgctactactataagagccctttatcgcaagagtaaaaacacttctcttttagaaaaaatatttcaaacatataatcctaatgccttgccccttatccaaaaaatagagtgggtacaggctgatattttggatgttccagctttagaaagngcactacaaggggtggacttcctttatcattgtgcaggtatggtctcctttgacgattcagatgcccaactactttatcagaacaacgtagaaggtactgcaaatatagtgaatatagccctatatcggggagtgaaaaaactttgttatgtgagtactattgctactttctcagcaaaagaaggaacagaggttaccgaacaaactccacaagagctatctgttgccaatgacaaagcctatgctctgagcaaatacagtgcagaaatggaagtatggagaggagtacaagagggcttgcctgcgatagtcgtatatccttcagtagtggtaggagtaggagtggaacaacattcggcaatgaatattcaaaaactatgtagaagtcgatatattacccagggggggacaggttttgtagcagctcaggatgtagcccatgctatgcgactacttatggaatcctttgtagagaatcaggggttcatcctcagtggcgaaaatctttcctatcagcagttttttcaatacctcagcgaaagtcatcctaagcttcctaagaaaaaaatgctatccactaatgccttgcgttggctttcctatgcagatacttttttatcctttttcgggaagaagcgacaactctcgcctaagatggtgcaaacactacaatctgtctccttttacaatggagagaagataacccatacccttccttttacttatactcccatacaagaagtactgaagaggttagtattataatttttaactacttaataaccaataaattattaaaatcaaggattatgatgttacacagaaaaatantngttattaccntacttttattcttaggagggggactgttcgtacaggcacaaacacgtgtttcnggtcaagtgatngatgagcaaggagaaccgattccctttgcnaatgttatttttaaaaacactcatataggaaccgcttgtgatgagaacggtaagttttctcttttctctcagaaaaattataccactattgaagtgtcttcagtagggtttaccactaaggaagtaaagctcaaagggcatgataccgaaaagttgaaaatagtgttggctatagaagagttggaggccttagtctttgtggaaaaacctaagaagaatctttcgaaaaaggagaatccagcctatcctattctacaaaaaatatgggctaataagcataaaaatatacttacccaaaccaaggcttatcagtacaaacgctatgagactgtggagttgggattgaacaacttagactctgttttcctaaaaaaagccttacagtctgaatataaagagataagaaacattctttccgagaaaaagtacaagcaatacttctctatgccta

SEQ ID NO: 1633 - DNA, 4000 bp, Escherichia coli
  misc_feature (169)..(169): n is a, c, g, or t
  misc_feature (187)..(187): n is a, c, g, or t
  misc_feature (334)..(334): n is a, c, g, or t
  misc_feature (525)..(525): n is a, c, g, or t
  misc_feature (1059)..(1059): n is a, c, g, or t
  misc_feature (1263)..(1263): n is a, c, g, or t
  misc_feature (1470)..(1470): n is a, c, g, or t
  misc_feature (1491)..(1491): n is a, c, g, or t
  misc_feature (1692)..(1692): n is a, c, g, or t
  misc_feature (1782)..(1782): n is a, c, g, or t
  misc_feature (1818)..(1818): n is a, c, g, or t
  misc_feature (1926)..(1926): n is a, c, g, or t
  misc_feature (2040)..(2040): n is a, c, g, or t
  misc_feature (2070)..(2070): n is a, c, g, or t
  misc_feature (2169)..(2169): n is a, c, g, or t
  misc_feature (2508)..(2508): n is a, c, g, or t
  misc_feature (2574)..(2574): n is a, c, g, or t
  misc_feature (2700)..(2700): n is a, c, g, or t
  misc_feature (2814)..(2814): n is a, c, g, or t
  misc_feature (2824)..(2824): n is a, c, g, or t
  misc_feature (3881)..(3881): n is a, c, g, or t
gcactagccgaagagctccaggtaggcctggtataccagcagcacctgctccgagaactccgcattgcggtccgtgagcggggccagcttgatgatcgtcgccgccagcgccggccccaccgtgtcgggggtatgcacgcgaatgccggaaaactgcgcccgggtcacnctcgccgccgcatacagngccgaaaaatccgccacgtccacgtcgtattccgcgcaaaacacgtccgcgataatgagcaattgctccccgcttaacgacggaaaacccatggcttacccgcggtttctccgaattcgggccgccaacacggcctgctccgggatnatggtttccgcgagttgggcgatgtgggcgtcggcaagcgtgcgttgggcggagaccacgatggcgcgcacggcggcctcttgcttgctgcaaccccaggcgtcggcaagcagggagagggcgcgatcttggtgggaatctagtcgaagcgtcatggccatggtatcactatgataccactagttgggcangcggtatcatgggatgctgtgagtgattatgatcgtattctccccatcgacctcaacgaggagatgcaaacctcctacattgactacgccatgtcggtcattgtgggtcgggcgctgccggaggttcgggacggcctgaagcccgtccaccgccgcatcctctacgccatgtacgactccggctatcggcccgaccgcggctatgtcaagtccgcccggcccgtgtcggacaccatgggccaattccacccgcacggcgactccgctatctacgacaccctggtgcggctcgcccaggactggaatatgcgctacccgctggtcgacggccagggcaactttggttcccgcggcaacgacggccccgccgccatgcggtacaccgagtgtcggctcaccccgctcgccatggaaatggtgcgggacatccgcgaaaacaccgtggatttctcccccaactacgacggcaaaaccatggaacccgacattttgccgtcccgggtgccgaacctgctcatgaacggctccaacggnattgccgtgggcatggccaccaacattcccccgcacaacctgcgggagctggccgacgccatctattggctgttggaaaacccggatgcggacgacgccaccgccctggaagcctgcatggagcatatcaagggccccgatttccccaccgccggcctcatcgttggcacccagggcatcaaggacgcctacaccaccgggcgnggttccatccgcatgcgcggcgtgaccagcatcgaggaggagggcagccggcaaaccattgtgattaccgaactgccctaccaggtcaacccggataatctgatttccagcatcgccgagcaggtgcgggacggtaaacttgccggcatctccaagatcgaggacgaatcctccgaccgggtgggcatgcgcatcgtggtcacgctnaagcgggatgccgtgccgcgngtggtgctcaataacctgtataagcactcccagctgcaaaccaacttcggtgcgaacatgctttcgatcgttgatggggtgccgcgcacgctccggctggatcagatgctccgctactatgtggcccaccagatcgaagtgatcgtgcgccgcacccaatatcgcctggacgaggcggagaagcgggcccacattctgcgnggcctggtgaaggccctcgacatgttggacgaggtcattgcgctgatccgccggtcggaaaccgtggatgttgcccgccgcggcctcatngacctgctcaccattgacgaggtgcaggccgatgcnattctcgccatgcagctgcggcgcctggccgccctggaacgccagaagatcattgatgagctcgccgagatcgaggcgatcattgccgacctgaaggacattttggcntccccgggccggcagcgcgccattgtccgcgatgaactgaaagagattgtggacaagtacggtgacgatcgccggtcgcaaatcattgccgccaccggtgacgtgaccgaagangacctgatcgcccgcgaaaacgtggtggtnaccatcacgtctacggggtatgcgaagcgcaccaaggtggatgcgtataagtcgcagcgccgcggcggcaagggggtgcggggcgccgagctgaagcangacgatgtggtgcggcacttctttgtgtgctccacccacgactggattctgttcttcaccaattttggtcgggtgtaccggttgaaggcctacgagttgccggaggcgtcccggacggcccgcgggcagcacgtggcgaacctgctggaattccagccggaggagcggattgctcaggtcattcagatccaaagctatgaggatgccccctacctggtgttggcgacggttcagggtcgggtgaaaaagtcccggctgtccgactatgaatccgctcgttccggcgggttgattgcgattaacctgaatgagggagacaagctcattggcgcttcgctntgttccaatgaggacgatttattgttggtgtctgaggaaggtcaatccattcggtttagcgccgangatgaacagttgcgccccatgggtcggtcgacggcgggggtaaaggggatgcgattccggggtgacgatcatctgctcgccatgacggtggttcgggacggttcgtaccttctggtggcgaccgcnggcggctacgggaagcggacgtcgatggacgaatattccgtgcaaggccggggtggggtcggtgttgtaacattcaaatacaacccgaaacggggcaaattgattggcgcgttngcggtcgatnatgacgaccaaatctttgccattacctccgccggcggggttattcggacggaagtaaaccaaatccgaccaagctctcgtgccacaatgggagttcgtttggttaatctagaagacggcattgagctccttgccatcgaccgtaatgttgagggcgaaggcgaggaggaagtagaagccgtggctactgccaagtcgcgcgctcctaagcaagaaaccattgaggaagaagattaatggctactcgtgaatacacggtgcaacgtattgccccgatgtcggcgttccgcacggcgttttcgctctctatcatcggcctggcggcctggataatttgtgctgtggtgctctatttaggcatggcggcgtttggggtgtgggaccaggtcaatcaggttattggtggcgtgggcggcgaccaaaccctatcgtttggcgtggtgatgtccctggtggcactcattggcgctatttttgccatctttttctccgcgctcgccccgctgactgcggtgctgtataacgcggtggtggatttgtttggtggcattcgcgtgacactccgctacgaagcagagtagaatagctttacgacgctgtaacgcaggcgaaactaggccccgagcaggcgatttgccaagtcccggtcatactgggtaaagttctatctcgttccccggggcctatagctcagtcggttagagcgcatcgctgataacgatgaggtcgcaagttcgattcttgctaggcccactggaacatggggcattagctcaattggtagagcatctgctttgcaagcagaaggtcaggagttcgattctcctatgctccacaataagggccgtcaatcataatgattgacggccctaaaactattggaggatgagggtggttaacctaaagttggggtaagggtgggggtgattgccggccagatatcattaaaaactatgcaagttaggcaatccaaacctccctatcggctcagtgcccaagcccggcttaccattgtctgttcggtgcttttgacctggctttccgtcgtgggaatgtcnttatccatcatgggggccggggccgtcattgatgggggtggcagcgagctgattctgtggggagtgattctcacgtttgccaccatcatgatccgcaccatggtggtggcccggggtca

SEQ ID NO: 1634 - DNA, 4000 bp, Escherichia coli
  misc_feature (592)..(592): n is a, c, g, or t
  misc_feature (2152)..(2152): n is a, c, g, or t
  misc_feature (2423)..(2423): n is a, c, g, or t
  misc_feature (3348)..(3348): n is a, c, g, or t
  misc_feature (3435)..(3435): n is a, c, g, or t
tgacgtagctgcaatatcttcaacactcacaaacccctcagcaacaagcagatgagcgataacatcatcaatattcaatgcttctatgaaacgggttgagcgggttttgaattcttcctgacgacgctctgattcttcagcttctgtcagaatatcgatataccagccagttaattgagaggcgaggcggacattctgaccgcggcgaccaatggcaagactaagctgttcgtccggcacaacaacctcaacccggcctgcaacttcatcaacaacaaccttggcaacttctgccggagcaagagcgttcacgatgaaggtgacgggatcttctgagaaaggaataatctcaatcttttcaccctgcaattcaccaacaactgcctgaacacggctaccgcgaagaccaacacaagcgccaacggggtcaatgctgctatcacgtgatacaacagaaatcttcgctcggcttcccggctctcttgcaacagccttaatttcgataatgccgtcataaatctcaggcacttcttgaacaaatagctttgccataaattcgtttgctgcccgtgataggaaaatctgagggccncgaggctcttcgcgcacatcaacaatataggcgcgcactctatcgccctgattgaaattttcacgtggaatcatctggtcacggcgtatcacgccttcagcgcggccaaggtcaacagtgatagaatagctctcagcacgttttacggtaccaataacaacttccccaacacggtccttatattcctgatattggcgcgcccgctcagcttcacgcactttttgcgagataacctgttttgctgtctgggctgcaatccggccaaattcaatggggggaagtggctggcgcaaaaattcgccaagaccaacctggtgtttagtgccttcagtcacagtcatctgggtttcgtcattctcgacttcttcgacaacttcagtccaacgctcaagatggatagagccagttttacgatcgatcatagcgcgaatatcacggtcattaccgtatttcgagcgtcccgctttttgaatagcttcttccatcgcaatgatgacctcttcgcggtcaatcgatttctcacgcgccaccacatctgcaatttgcatcaattcaagtccgggaatagatgatgtatccataacgtctgtcctttttatattatctcttatgagccccccatgggctgataagacatttatcttctctaataactagccagcatctgtttctgatgaagccttatcatcctgtgcgctagcatccttagccttattttttttctcgtctcttcggagctgctgtttcagcgttgagaaaaattcggtcgggtcaattttggccgtatctatttcctcaaaggcaaaactaacacgccctgttcctgtatccagatggattaagttaccttcatctacgccaccaagccgaccacgaaaacgtttttggccattacgcgcctgtaatagtgaaaccttagcaagctcgccggaaaaacgggtaaaatctgcaagacgggtaagcggtctatccattccaggagagctcacctcaagctgataggcttcacttatcgggtcttcaacatccagaacagcggcaagctgacggctaatcagcgtgcaatcttcaaccgtcatttcacggctttcgattggttcagccataatctggagctgagagcgcgcttttccgtctgcgccaacgcctgaaaaacggacgcgcacaagcgaaaaccccaaatcgtttagggtcggttcgattatcttattaagcttttcagagaccatccctgccctgctcttttacaatttattatatttagggtcgttaaccttagtgtcactgcgtttcgtgtttgccataatcgcatgtagccaaccaagaaggcgggcacttttaggcaacaaaaaaggcgggcttttggcccaccgcttcaaaagaaaccgtcatgtgatgcttgtcttacgccacattcatgcaaaaagcaagtcacgcaccttatcgacgcgcaaaatcaaaccagcttgacgcacggccttccctggtccccttcgccatatagcgcgtttcaggccagttttcaggacggcggcgccagtcagctgcggtttctgcgcnccactcaaaagcaggatggcgcatggcttctgctaacagccatgtctttgctatcggatgatcacttgccatccgaagaaagccgcccggcgcaaccaagcgggcaaggctatcaagcattttttgagacagaatgcgacgatatgcatgccgtcgtttcggccatggatcgggaaacatcacataaacaccgtcaagacagcccggttccatgacttcaagcaaggggcgcacatcatcagaccagatacgaatattgctcagctcatgntcatctatctggcgcacaaggctcgccaccccgttgatgaatggctcagcgccgataaatcctgcctgcggattgccagcagcaagttgagcaagatgctcacctcccccaaaaccgatttccagaaataacgcgtccttatgactatcaaactggcttgcaagcggtgcagatgttagggctgccttatcaacagagagacgcggtagttctgtgctcagtagctgcttcatatgggcgcttagcgcgcgcccttttcgcctaccataaaaatgatagtccggaagagacgatggccgcgtgcctgtcatcaaagtgacctttttctgtctttagccacgataagcaacgctacagacttgccttaatcgcatcaaccaaatcggttgcttcccagctaaatgtacctgcgcccgcttcgcctgcttttctgccaaaatggccatatgcagatgtcggtgtgtaaattgcattattcagaccaagatgcgtgcgaatcccttgcggccgtaaatccatgatatcacctttggtaaacagagcggcaagaatggcatctgatacagtgcccgtaccatggctatttacatagacagaaaccggggctgcaacaccaatggcgtaggcaatctggatcgtacatttttcagcaagaccacttgcaacaacgtttttcgcaagatagcgcgcagcataggcagctgaccggtcaacttttgttgggtcttttcctgaaaacgcgccgccaccatgaggcgcagcaccgccataggtatcaacaatgattttgcggcccgtcagtccagcatcaccatccggtccaccaataacaaaattacctgttggattaatcagaaagtccttagcgccaaccatccagccatctggcaggagctctgctgcaagaggggttatcagcgctctnatatccgcttcactcacaccttctttatgctgggtagacacaacaagcgtttcaacaccctcgatgctgccatcatctgcgtagcgnagggttatctggcttttcgcatcaggtccaagaatactatcagcatcctgtttacgcagatctgccatttgtttcagaagctgatgggcataatgaatcggagccggcattaactcttctgtttcaccgcacgcatagccaaacatcaagccctgatcaccagcgccttcttccttattatcagagctatcaacaccagcagcaatatcagcagactgctcatgcaaataattctgaaattcaaaatgagcatggtggaatttttcctgctcatatccaatgtcagcaatcgctccgcgtacctcagcttctatctgttccataatggagggcatattatctttagacgcacgaacctcgccagcaagaacaatcctatttgtcgtcgctagtgtctcacaagctactctggcttcgctttcatgacgaagaaacaaatcgagtacagtatcagagacacggtcacaaactttatccggatgaccttcggatactgattcagaggtaaaaagataagccaaaataaccctcgcagacgctgttcatattagatttttaagcatat

SEQ ID NO: 1635 - DNA, 4000 bp, Escherichia coli
  misc_feature (1)..(1): n is a, c, g, or t
  misc_feature (5)..(5): n is a, c, g, or t
  misc_feature (8)..(10): n is a, c, g, or t
  misc_feature (12)..(14): n is a, c, g, or t
  misc_feature (16)..(33): n is a, c, g, or t
  misc_feature (36)..(47): n is a, c, g, or t
  misc_feature (49)..(65): n is a, c, g, or t
  misc_feature (68)..(89): n is a, c, g, or t
  misc_feature (91)..(110): n is a, c, g, or t
  misc_feature (112)..(118): n is a, c, g, or t
  misc_feature (120)..(122): n is a, c, g, or t
  misc_feature (124)..(139): n is a, c, g, or t
  misc_feature (141)..(165): n is a, c, g, or t
  misc_feature (167)..(193): n is a, c, g, or t
  misc_feature (195)..(206): n is a, c, g, or t
  misc_feature (208)..(208): n is a, c, g, or t
  misc_feature (210)..(259): n is a, c, g, or t
  misc_feature (261)..(278): n is a, c, g, or t
  misc_feature (280)..(284): n is a, c, g, or t
  misc_feature (286)..(288): n is a, c, g, or t
  misc_feature (291)..(306): n is a, c, g, or t
  misc_feature (308)..(319): n is a, c, g, or t
  misc_feature (321)..(322): n is a, c, g, or t
  misc_feature (324)..(329): n is a, c, g, or t
  misc_feature (331)..(332): n is a, c, g, or t
  misc_feature (334)..(339): n is a, c, g, or t
  misc_feature (341)..(367): n is a, c, g, or t
  misc_feature (369)..(375): n is a, c, g, or t
  misc_feature (377)..(391): n is a, c, g, or t
  misc_feature (393)..(393): n is a, c, g, or t
  misc_feature (396)..(396): n is a, c, g, or t
  misc_feature (398)..(400): n is a, c, g, or t
  misc_feature (402)..(427): n is a, c, g, or t
  misc_feature (430)..(431): n is a, c, g, or t
  misc_feature (433)..(438): n is a, c, g, or t
  misc_feature (440)..(452): n is a, c, g, or t
  misc_feature (454)..(460): n is a, c, g, or t
  misc_feature (462)..(511): n is a, c, g, or t
  misc_feature (513)..(514): n is a, c, g, or t
  misc_feature (516)..(525): n is a, c, g, or t
  misc_feature (527)..(532): n is a, c, g, or t
  misc_feature (534)..(554): n is a, c, g, or t
  misc_feature (556)..(559): n is a, c, g, or t
  misc_feature (561)..(573): n is a, c, g, or t
  misc_feature (577)..(581): n is a, c, g, or t
  misc_feature (583)..(587): n is a, c, g, or t
  misc_feature (589)..(590): n is a, c, g, or t
  misc_feature (592)..(592): n is a, c, g, or t
  misc_feature (594)..(595): n is a, c, g, or t
  misc_feature (598)..(598): n is a, c, g, or t
  misc_feature (600)..(601): n is a, c, g, or t
  misc_feature (604)..(604): n is a, c, g, or t
  misc_feature (606)..(606): n is a, c, g, or t
  misc_feature (608)..(612): n is a, c, g, or t
  misc_feature (615)..(618): n is a, c, g, or t
  misc_feature (621)..(622): n is a, c, g, or t
  misc_feature (624)..(626): n is a, c, g, or t
  misc_feature (628)..(628): n is a, c, g, or t
  misc_feature (630)..(633): n is a, c, g, or t
  misc_feature (635)..(637): n is a, c, g, or t
  misc_feature (639)..(639): n is a, c, g, or t
  misc_feature (641)..(644): n is a, c, g, or t
  misc_feature (646)..(652): n is a, c, g, or t
  misc_feature (654)..(654): n is a, c, g, or t
  misc_feature (656)..(656): n is a, c, g, or t
  misc_feature (658)..(674): n is a, c, g, or t
  misc_feature (676)..(680): n is a, c, g, or t
  misc_feature (682)..(692): n is a, c, g, or t
  misc_feature (694)..(703): n is a, c, g, or t
  misc_feature (705)..(706): n is a, c, g, or t
  misc_feature (709)..(709): n is a, c, g, or t
  misc_feature (711)..(724): n is a, c, g, or t
  misc_feature (726)..(731): n is a, c, g, or t
  misc_feature (733)..(733): n is a, c, g, or t
  misc_feature (735)..(737): n is a, c, g, or t
  misc_feature (741)..(744): n is a, c, g, or t
  misc_feature (746)..(761): n is a, c, g, or t
  misc_feature (763)..(767): n is a, c, g, or t
  misc_feature (769)..(770): n is a, c, g, or t
  misc_feature (772)..(779): n is a, c, g, or t
  misc_feature (781)..(781): n is a, c, g, or t
  misc_feature (785)..(785): n is a, c, g, or t
  misc_feature (787)..(788): n is a, c, g, or t
  misc_feature (790)..(797): n is a, c, g, or t
  misc_feature (800)..(800): n is a, c, g, or t
  misc_feature (802)..(802): n is a, c, g, or t
  misc_feature (805)..(805): n is a, c, g, or t
  misc_feature (807)..(808): n is a, c, g, or t
  misc_feature (810)..(814): n is a, c, g, or t
  misc_feature (816)..(817): n is a, c, g, or t
  misc_feature (820)..(828): n is a, c, g, or t
  misc_feature (830)..(834): n is a, c, g, or t
  misc_feature (836)..(855): n is a, c, g, or t
  misc_feature (857)..(857): n is a, c, g, or t
  misc_feature (859)..(866): n is a, c, g, or t
  misc_feature (869)..(872): n is a, c, g, or t
  misc_feature (874)..(875): n is a, c, g, or t
  misc_feature (877)..(878): n is a, c, g, or t
  misc_feature (880)..(881): n is a, c, g, or t
  misc_feature (883)..(884): n is a, c, g, or t
  misc_feature (886)..(904): n is a, c, g, or t
  misc_feature (906)..(912): n is a, c, g, or t
  misc_feature (914)..(914): n is a, c, g, or t
  misc_feature (916)..(921): n is a, c, g, or t
  misc_feature (923)..(927): n is a, c, g, or t
  misc_feature (929)..(933): n is a, c, g, or t
  misc_feature (935)..(935): n is a, c, g, or t
  misc_feature (937)..(953): n is a, c, g, or t
  misc_feature (955)..(956): n is a, c, g, or t
  misc_feature (958)..(959): n is a, c, g, or t
  misc_feature (961)..(966): n is a, c, g, or t
  misc_feature (969)..(974): n is a, c, g, or t
  misc_feature (976)..(979): n is a, c, g, or t
  misc_feature (982)..(988): n is a, c, g, or t
  misc_feature (992)..(995): n is a, c, g, or t
  misc_feature (997)..(1007): n is a, c, g, or t
  misc_feature (1009)..(1021): n is a, c, g, or t
  misc_feature (1023)..(1023): n is a, c, g, or t
  misc_feature (1025)..(1039): n is a, c, g, or t
  misc_feature (1041)..(1041): n is a, c, g, or t
  misc_feature (1044)..(1046): n is a, c, g, or t
  misc_feature (1048)..(1051): n is a, c, g, or t
  misc_feature (1053)..(1055): n is a, c, g, or t
  misc_feature (1058)..(1058): n is a, c, g, or t
  misc_feature (1060)..(1064): n is a, c, g, or t
  misc_feature (1066)..(1073): n is a, c, g, or t
  misc_feature (1075)..(1077): n is a, c, g, or t
  misc_feature (1079)..(1080): n is a, c, g, or t
  misc_feature (1082)..(1082): n is a, c, g, or t
  misc_feature (1084)..(1086): n is a, c, g, or t
  misc_feature (1088)..(1088): n is a, c, g, or t
  misc_feature (1090)..(1096): n is a, c, g, or t
  misc_feature (1098)..(1098): n is a, c, g, or t
  misc_feature (1100)..(1106): n is a, c, g, or t
  misc_feature (1108)..(1109): n is a, c, g, or t
  misc_feature (1111)..(1115): n is a, c, g, or t
  misc_feature (1117)..(1121): n is a, c, g, or t
  misc_feature (1123)..(1128): n is a, c, g, or t
  misc_feature (1130)..(1137): n is a, c, g, or t
  misc_feature (1139)..(1140): n is a, c, g, or t
  misc_feature (1142)..(1146): n is a, c, g, or t
  misc_feature (1148)..(1149): n is a, c, g, or t
  misc_feature (1152)..(1155): n is a, c, g, or t
  misc_feature (1157)..(1159): n is a, c, g, or t
  misc_feature (1161)..(1165): n is a, c, g, or t
  misc_feature (1167)..(1169): n is a, c, g, or t
  misc_feature (1172)..(1174): n is a, c, g, or t
  misc_feature (1177)..(1180): n is a, c, g, or t
  misc_feature (1182)..(1187): n is a, c, g, or t
  misc_feature (1189)..(1194): n is a, c, g, or t
  misc_feature (1196)..(1200): n is a, c, g, or t
  misc_feature (1203)..(1229): n is a, c, g, or t
  misc_feature (1231)..(1238): n is a, c, g, or t
  misc_feature (1240)..(1242): n is a, c, g, or t
  misc_feature (1244)..(1246): n is a, c, g, or t
  misc_feature (1248)..(1253): n is a, c, g, or t
  misc_feature (1255)..(1259): n is a, c, g, or t
  misc_feature (1261)..(1262): n is a, c, g, or t
  misc_feature (1265)..(1265): n is a, c, g, or t
  misc_feature (1267)..(1268): n is a, c, g, or t
  misc_feature (1270)..(1271): n is a, c, g, or t
  misc_feature (1273)..(1278): n is a, c, g, or t
  misc_feature (1280)..(1282): n is a, c, g, or t
  misc_feature (1284)..(1288): n is a, c, g, or t
  misc_feature (1290)..(1293): n is a, c, g, or t
  misc_feature (1295)..(1314): n is a, c, g, or t
  misc_feature (1316)..(1320): n is a, c, g, or t
  misc_feature (1323)..(1327): n is a, c, g, or t
  misc_feature (1330)..(1336): n is a, c, g, or t
  misc_feature (1338)..(1339): n is a, c, g, or t
  misc_feature (1341)..(1348): n is a, c, g, or t
  misc_feature (1351)..(1351): n is a, c, g, or t
  misc_feature (1354)..(1357): n is a, c, g, or t
  misc_feature (1360)..(1385): n is a, c, g, or t
  misc_feature (1387)..(1400): n is a, c, g, or t
  misc_feature (1402)..(1403): n is a, c, g, or t
  misc_feature (1405)..(1411): n is a, c, g, or t
  misc_feature (1413)..(1423): n is a, c, g, or t
  misc_feature (1426)..(1427): n is a, c, g, or t
  misc_feature (1429)..(1431): n is a, c, g, or t
  misc_feature (1433)..(1451): n is a, c, g, or t
  misc_feature (1453)..(1453): n is a, c, g, or t
  misc_feature (1456)..(1465): n is a, c, g, or t
  misc_feature (1467)..(1470): n is a, c, g, or t
  misc_feature (1473)..(1475): n is a, c, g, or t
  misc_feature (1478)..(1481): n is a, c, g, or t
  misc_feature (1483)..(1484): n is a, c, g, or t
  misc_feature (1486)..(1491): n is a, c, g, or t
  misc_feature (1493)..(1495): n is a, c, g, or t
  misc_feature (1497)..(1497): n is a, c, g, or t
  misc_feature (1499)..(1510): n is a, c, g, or t
  misc_feature (1512)..(1513): n is a, c, g, or t
  misc_feature (1516)..(1517): n is a, c, g, or t
  misc_feature (1520)..(1535): n is a, c, g, or t
  misc_feature (1537)..(1539): n is a, c, g, or t
  misc_feature (1542)..(1543): n is a, c, g, or t
  misc_feature (1548)..(1550): n is a, c, g, or t
  misc_feature (1552)..(1554): n is a, c, g, or t
  misc_feature (1556)..(1557): n is a, c, g, or t
  misc_feature (1561)..(1561): n is a, c, g, or t
  misc_feature (1567)..(1567): n is a, c, g, or t
  misc_feature (1569)..(1571): n is a, c, g, or t
  misc_feature (1573)..(1573): n is a, c, g, or t
  misc_feature (1577)..(1577): n is a, c, g, or t
  misc_feature (1579)..(1584): n is a, c, g, or t
  misc_feature (1586)..(1586): n is a, c, g, or t
  misc_feature (1590)..(1590): n is a, c, g, or t
  misc_feature (1593)..(1593): n is a, c, g, or t
  misc_feature (1595)..(1595): n is a, c, g, or t
  misc_feature (1597)..(1598): n is a, c, g, or t
  misc_feature (1600)..(1606): n is a, c, g, or t
  misc_feature (1608)..(1612): n is a, c, g, or t
  misc_feature (1614)..(1615): n is a, c, g, or t
  misc_feature (1617)..(1620): n is a, c, g, or t
  misc_feature (1622)..(1622): n is a, c, g, or t
  misc_feature (1626)..(1627): n is a, c, g, or t
  misc_feature (1630)..(1630): n is a, c, g, or t
  misc_feature (1634)..(1638): n is a, c, g, or t
  misc_feature (1640)..(1641): n is a, c, g, or t
  misc_feature (1643)..(1643): n is a, c, g, or t
  misc_feature (1647)..(1647): n is a, c, g, or t
  misc_feature (1650)..(1651): n is a, c, g, or t
  misc_feature (1653)..(1656): n is a, c, g, or t
  misc_feature (1658)..(1659): n is a, c, g, or t
  misc_feature (1662)..(1662): n is a, c, g, or t
  misc_feature (1667)..(1667): n is a, c, g, or t
  misc_feature (1670)..(1678): n is a, c, g, or t
  misc_feature (1681)..(1682): n is a, c, g, or t
  misc_feature (1686)..(1688): n is a, c, g, or t
  misc_feature (1691)..(1692): n is a, c, g, or t
  misc_feature (1696)..(1699): n is a, c, g, or t
  misc_feature (1702)..(1706): n is a, c, g, or t
  misc_feature (1711)..(1711): n is a, c, g, or t
  misc_feature (1716)..(1716): n is a, c, g, or t
  misc_feature (1721)..(1722): n is a, c, g, or t
  misc_feature (1725)..(1726): n is a, c, g, or t
  misc_feature (1728)..(1728): n is a, c, g, or t
  misc_feature (1730)..(1730): n is a, c, g, or t
  misc_feature (1735)..(1737): n is a, c, g, or t
  misc_feature (1740)..(1746): n is a, c, g, or t
  misc_feature (1749)..(1751): n is a, c, g, or t
  misc_feature (1755)..(1756): n is a, c, g, or t
  misc_feature (1760)..(1762): n is a, c, g, or t
  misc_feature (1765)..(1767): n is a, c, g, or t
  misc_feature (1770)..(1771): n is a, c, g, or t
  misc_feature (1773)..(1778): n is a, c, g, or t
  misc_feature (1827)..(1827): n is a, c, g, or t
  misc_feature (1831)..(1831): n is a, c, g, or t
  misc_feature (1874)..(1874): n is a, c, g, or t
  misc_feature (1884)..(1884): n is a, c, g, or t
  misc_feature (1887)..(1887): n is a, c, g, or t
  misc_feature (1939)..(1939): n is a, c, g, or t
  misc_feature (1944)..(1945): n is a, c, g, or t
  misc_feature (1950)..(1952): n is a, c, g, or t
  misc_feature (1954)..(1954): n is a, c, g, or t
  misc_feature (1962)..(1962): n is a, c, g, or t
  misc_feature (1974)..(1974): n is a, c, g, or t
  misc_feature (1985)..(1985): n is a, c, g, or t
  misc_feature (1988)..(1988): n is a, c, g, or t
  misc_feature (1997)..(1997): n is a, c, g, or t
  misc_feature (3979)..(3979): n is a, c, g, or t
ngcangcnnnannncnnnnnnnnnnnnnnnnnnagnnnnnnnnnnnngnnnnnnnnnnnnnnnnnccnnnnnnnnnnnnnnnnnnnnnncnnnnnnnnnnnnnnnnnnnngnnnnnnncnnncnnnnnnnnnnnnnnnncnnnnnnnnnnnnnnnnnnnnnnnnnannnnnnnnnnnnnnnnnnnnnnnnnnnannnnnnnnnnnncncnnnnnnnnnnnnnnnnnnnnnnnnnnnnnnnnnnnnnnnnnnnnnnnnnntnnnnnnnnnnnnnnnnnncnnnnncnnnatnnnnnnnnnnnnnnnncnnnnnnnnnnnncnnannnnnngnncnnnnnnannnnnnnnnnnnnnnnnnnnnnnnnnncnnnnnnncnnnnnnnnnnnnnnnanaangnnnannnnnnnnnnnnnnnnnnnnnnnnnngcnnannnnnnannnnnnnnnnnnncnnnnnnncnnnnnnnnnnnnnnnnnnnnnnnnnnnnnnnnnnnnnnnnnnnnnnnnnngnntnnnnnnnnnntnnnnnnannnnnnnnnnnnnnnnnnnnnannnnannnnnnnnnnnnncgannnnnannnnnannangnngangnngangncnnnnncgnnnncanngnnntngnnnngnnnangnnnntnnnnnnncngngnnnnnnnnnnnnnnnnnannnnnannnnnnnnnnntnnnnnnnnnncnnatncnnnnnnnnnnnnnncnnnnnncncnnncccnnnncnnnnnnnnnnnnnnnnannnnnannannnnnnnngngaangnnannnnnnnnagngnaanannannnnnannatnnnnnnnnncnnnnnannnnnnnnnnnnnnnnnnnncnannnnnnnnagnnnnannannannannannnnnnnnnnnnnnnnnnncnnnnnnngntnnnnnncnnnnncnnnnncncnnnnnnnnnnnnnnnnnanngnnannnnnnggnnnnnnannnnaannnnnnngacnnnntnnnnnnnnnnnannnnnnnnnnnnngnannnnnnnnnnnnnnncnagnnnannnncnnnagnannnnnannnnnnnncnnngnncntnnntnannnnnnnanannnnnnnannannnnnannnnnannnnnnannnnnnnnannannnnngnnacnnnnannnannnnnannnaannncannnncnnnnnntnnnnnnannnnnaannnnnnnnnnnnnnnnnnnnnnnnnnngnnnnnnnnannnannnannnnnnannnnnannatnannannannnnnntnnncnnnnncnnnnannnnnnnnnnnnnnnnnnnncnnnnncannnnnagnnnnnnngnngnnnnnnnnagnaannnngannnnnnnnnnnnnnnnnnnnnnnnnnannnnnnnnnnnnnnanngnnnnnnncnnnnnnnnnnngannannncnnnnnnnnnnnnnnnnnnnangannnnnnnnnngnnnnctnnngcnnnngnngnnnnnngnnntncnnnnnnnnnnnnannagnnatnnnnnnnnnnnnnnnntnnnggnnggagnnntnnngnngggngggggngnnnanaccncnnnnnncncccnccntngnncnnnnnnngnnnnnanngnnnntntttnnagngggnnnnnanntntttnccnngnnnngnnccnccttnggnnnnnnnnnaanngggnnnggnngagnnnnaannnnnaaggnggggnaaggnnaannananagggnnnaannnnnnnttnnnaaannggannnggnnnaannannnnnnccccaggaggcggagctatagtgtggggagaggaaagctatactggtcnctgngcattcctatataggaacgagcgtgaaccaatactgctccgangacgaaccantantggtccgacgacgaagctatatagcttcataccgctatgcagtagtgcttcngaggnnccacnnncntggtgatnccacagagaagnggagaaagggnttngggaaaagngaagaaggagactataccacgggatagtggtacagtctccttccttagggttggatagctaagtgcttaccagctggccttcttcaccccagggatgagaccggcagaagccatctcacggaactggatacgagagatgccgaactggcgcatatagcccttgggacgacccgtcatgctgcagcggttgtgcagacgtacgggagaagcgttcttaggcagagcctgaagtgcttcgtagttcccttcggccttgagctgagcacgcttggcagcatacttagcgacgagctttgcacgctttacttcgcgtgccttcattgattcctttgccatagtatttagttgcctttcttagcgttcttgaatgggaggccgaactccttgaggagtgcgtaaccttcttcgtcagtctgagccgaggtaacgaacgtgatgttcataccgaggatcttggtgatgccgtcgaggttgatctcagggaagatgatctgctcgctgataccgagggtatagttaccacggccatcgaacttgctttcgatccccttgaagtcacggatacggggcagcgcgatacggatcagacgctcgaggaactcgtacatctgctcgcggcgcagggtaaccataacaccgataggcatcttcttacgaagcttgaagttagagatgtccttcttcgaaaccgtagcaacagccttctgaccggtgatggcagagagttctgcgatagctacgtcgatgatcttcttatcagccgtagccataccgaggccctggttgatgacgatcttcttcaggacgggcacctgcatgcgagactgataaccgaactgctcgatgagggcgggaacgatgcgttccttatattcgttcttaagacttgcagtattgctcattacttaatctcctctcctgactttttggaataacgtacgagcttcccttcgtcgttgagacgacgaccgatacgcgtagccttacccgtcttaggatcgacgaggttgagcttagcgatatggataggagcttccttcttctcgatccctccctgagggttctttgcgctgggcttagcgtgcttagcgacgatggctacgccttcgacgatagcgcgctgcttgtctacgaggacttcaagcacacggcccgtcttccccttatctacaccgctgaggacgacgacctggtcgcccttcttgatatgtaacttactcatttcttctttcgtctttaagggttagaggacttcaggcgcgagagaaacgatcttcatattcacggcacgcagctcacgagctacagggccgaagatacggctaccacgcatatcgccagcagcattgagcaggacgcaagcgttgtcatcgaagcggatgtaggagccgtcgggacgacgaacttccttcttcgtgcggacgatgattgccttagatacgacacccttcttcaggtcagaagaggggatgacgctcttgacagcaacgacgatgatatcaccgacagaggcatagcgacggcgcgtaccgccgaggacgcggatacagagggcttcctttgcaccgctattgtctgctactacgagtcttgattcttgctggatcatatactacttagctctttcgataatattgactaatctccatctcttggtacggctcaaagggcgagtctccatgatacggaccgtatcaccgatgttgcactcgttcttctcgtcgtgagcatggtacttcttcgtcttgttgacgaacttaccatagatagggtgcttttccttccacttgacagcgaccgtaatggtcttgtccatcttattggaagaaacgacgcctacacgttcttttcttaatcttctctgttccatcgggaggacacattaattgttgttgagttcgcgctcacgaaggatggtcttcatctgagcgatcgtgcggcgcatgcggcggatctcagcagggttgtctgcgggggtcacngcatggtcgatgcacttcttg

SEQ ID NO: 1636 - DNA, 4000 bp, Escherichia coli
  misc_feature (1)..(1): n is a, c, g, or t
  misc_feature (3)..(4): n is a, c, g, or t
  misc_feature (6)..(7): n is a, c, g, or t
  misc_feature (10)..(10): n is a, c, g, or t
  misc_feature (12)..(12): n is a, c, g, or t
  misc_feature (14)..(16): n is a, c, g, or t
  misc_feature (20)..(21): n is a, c, g, or t
  misc_feature (25)..(27): n is a, c, g, or t
  misc_feature (30)..(30): n is a, c, g, or t
  misc_feature (32)..(32): n is a, c, g, or t
  misc_feature (34)..(34): n is a, c, g, or t
  misc_feature (36)..(37): n is a, c, g, or t
  misc_feature (39)..(40): n is a, c, g, or t
  misc_feature (42)..(44): n is a, c, g, or t
  misc_feature (47)..(47): n is a, c, g, or t
  misc_feature (50)..(52): n is a, c, g, or t
  misc_feature (54)..(56): n is a, c, g, or t
  misc_feature (58)..(58): n is a, c, g, or t
  misc_feature (60)..(61): n is a, c, g, or t
  misc_feature (63)..(63): n is a, c, g, or t
  misc_feature (65)..(65): n is a, c, g, or t
  misc_feature (71)..(71): n is a, c, g, or t
  misc_feature (73)..(73): n is a, c, g, or t
  misc_feature (75)..(75): n is a, c, g, or t
  misc_feature (77)..(82): n is a, c, g, or t
  misc_feature (84)..(84): n is a, c, g, or t
  misc_feature (87)..(89): n is a, c, g, or t
  misc_feature (92)..(92): n is a, c, g, or t
  misc_feature (94)..(95): n is a, c, g, or t
  misc_feature (97)..(97): n is a, c, g, or t
  misc_feature (99)..(102): n is a, c, g, or t
  misc_feature (105)..(105): n is a, c, g, or t
  misc_feature (108)..(108): n is a, c, g, or t
  misc_feature (110)..(110): n is a, c, g, or t
  misc_feature (112)..(116): n is a, c, g, or t
  misc_feature (118)..(118): n is a, c, g, or t
  misc_feature (122)..(122): n is a, c, g, or t
  misc_feature (125)..(126): n is a, c, g, or t
  misc_feature (128)..(129): n is a, c, g, or t
  misc_feature (132)..(132): n is a, c, g, or t
  misc_feature (134)..(134): n is a, c, g, or t
  misc_feature (138)..(139): n is a, c, g, or t
  misc_feature (141)..(142): n is a, c, g, or t
  misc_feature (144)..(145): n is a, c, g, or t
  misc_feature (148)..(148): n is a, c, g, or t
  misc_feature (150)..(150): n is a, c, g, or t
  misc_feature (152)..(152): n is a, c, g, or t
  misc_feature (160)..(161): n is a, c, g, or t
  misc_feature (163)..(165): n is a, c, g, or t
  misc_feature (168)..(168): n is a, c, g, or t
  misc_feature (170)..(170): n is a, c, g, or t
  misc_feature (173)..(174): n is a, c, g, or t
  misc_feature (177)..(178): n is a, c, g, or t
  misc_feature (183)..(183): n is a, c, g, or t
  misc_feature (185)..(186): n is a, c, g, or t
  misc_feature (188)..(188): n is a, c, g, or t
  misc_feature (190)..(190): n is a, c, g, or t
  misc_feature (192)..(192): n is a, c, g, or t
  misc_feature (194)..(199): n is a, c, g, or t
  misc_feature (202)..(204): n is a, c, g, or t
  misc_feature (206)..(206): n is a, c, g, or t
  misc_feature (208)..(208): n is a, c, g, or t
  misc_feature (210)..(210): n is a, c, g, or t
  misc_feature (212)..(212): n is a, c, g, or t
  misc_feature (214)..(215): n is a, c, g, or t
  misc_feature (217)..(218): n is a, c, g, or t
  misc_feature (220)..(220): n is a, c, g, or t
  misc_feature (223)..(228): n is a, c, g, or t
  misc_feature (230)..(230): n is a, c, g, or t
  misc_feature (232)..(233): n is a, c, g, or t
  misc_feature (235)..(238): n is a, c, g, or t
  misc_feature (241)..(241): n is a, c, g, or t
  misc_feature (243)..(243): n is a, c, g, or t
  misc_feature (245)..(248): n is a, c, g, or t
  misc_feature (251)..(252): n is a, c, g, or t
  misc_feature (256)..(257): n is a, c, g, or t
  misc_feature (260)..(260): n is a, c, g, or t
  misc_feature (262)..(264): n is a, c, g, or t
  misc_feature (267)..(267): n is a, c, g, or t
  misc_feature (269)..(269): n is a, c, g, or t
  misc_feature (271)..(272): n is a, c, g, or t
  misc_feature (274)..(274): n is a, c, g, or t
  misc_feature (276)..(276): n is a, c, g, or t
  misc_feature (278)..(278): n is a, c, g, or t
  misc_feature (280)..(282): n is a, c, g, or t
  misc_feature (284)..(284): n is a, c, g, or t
  misc_feature (287)..(288): n is a, c, g, or t
  misc_feature (290)..(290): n is a, c, g, or t
  misc_feature (293)..(293): n is a, c, g, or t
  misc_feature (296)..(297): n is a, c, g, or t
  misc_feature (299)..(301): n is a, c, g, or t
  misc_feature (303)..(303): n is a, c, g, or t
  misc_feature (305)..(311): n is a, c, g, or t
  misc_feature (313)..(314): n is a, c, g, or t
  misc_feature (316)..(319): n is a, c, g, or t
  misc_feature (321)..(326): n is a, c, g, or t
  misc_feature (329)..(330): n is a, c, g, or t
  misc_feature (333)..(334): n is a, c, g, or t
  misc_feature (336)..(337): n is a, c, g, or t
  misc_feature (339)..(339): n is a, c, g, or t
  misc_feature (343)..(345): n is a, c, g, or t
  misc_feature (347)..(348): n is a, c, g, or t
  misc_feature (352)..(354): n is a, c, g, or t
  misc_feature (356)..(357): n is a, c, g, or t
  misc_feature (360)..(361): n is a, c, g, or t
  misc_feature (363)..(363): n is a, c, g, or t
  misc_feature (365)..(365): n is a, c, g, or t
  misc_feature (368)..(368): n is a, c, g, or t
  misc_feature (370)..(371): n is a, c, g, or t
  misc_feature (374)..(375): n is a, c, g, or t
  misc_feature (377)..(377): n is a, c, g, or t
  misc_feature (379)..(381): n is a, c, g, or t
  misc_feature (384)..(387): n is a, c, g, or t
  misc_feature (389)..(390): n is a, c, g, or t
  misc_feature (392)..(392): n is a, c, g, or t
  misc_feature (395)..(395): n is a, c, g, or t
  misc_feature (398)..(401): n is a, c, g, or t
  misc_feature (404)..(405): n is a, c, g, or t
  misc_feature (409)..(410): n is a, c, g, or t
  misc_feature (412)..(412): n is a, c, g, or t
  misc_feature (414)..(414): n is a, c, g, or t
  misc_feature (416)..(416): n is a, c, g, or t
  misc_feature (418)..(419): n is a, c, g, or t
  misc_feature (421)..(423): n is a, c, g, or t
  misc_feature (425)..(425): n is a, c, g, or t
  misc_feature (427)..(429): n is a, c, g, or t
  misc_feature (431)..(434): n is a, c, g, or t
  misc_feature (436)..(436): n is a, c, g, or t
  misc_feature (439)..(439): n is a, c, g, or t
  misc_feature (443)..(443): n is a, c, g, or t
  misc_feature (446)..(446): n is a, c, g, or t
  misc_feature (450)..(450): n is a, c, g, or t
  misc_feature (453)..(456): n is a, c, g, or t
  misc_feature (458)..(458): n is a, c, g, or t
  misc_feature (460)..(460): n is a, c, g, or t
  misc_feature (462)..(462): n is a, c, g, or t
  misc_feature (466)..(466): n is a, c, g, or t
  misc_feature (468)..(470): n is a, c, g, or t
  misc_feature (475)..(475): n is a, c, g, or t
  misc_feature (477)..(478): n is a, c, g, or t
  misc_feature (480)..(480): n is a, c, g, or t
  misc_feature (482)..(483): n is a, c, g, or t
  misc_feature (487)..(487): n is a, c, g, or t
  misc_feature (489)..(489): n is a, c, g, or t
  misc_feature (492)..(493): n is a, c, g, or t
  misc_feature (495)..(498): n is a, c, g, or t
  misc_feature (500)..(501): n is a, c, g, or t
  misc_feature (504)..(506): n is a, c, g, or t
  misc_feature (508)..(510): n is a, c, g, or t
  misc_feature (513)..(515): n is a, c, g, or t
  misc_feature (518)..(521): n is a, c, g, or t
  misc_feature (523)..(524): n is a, c, g, or t
  misc_feature (526)..(526): n is a, c, g, or t
  misc_feature (528)..(533): n is a, c, g, or t
  misc_feature (535)..(539): n is a, c, g, or t
  misc_feature (542)..(542): n is a, c, g, or t
  misc_feature (545)..(545): n is a, c, g, or t
  misc_feature (547)..(548): n is a, c, g, or t
  misc_feature (550)..(551): n is a, c, g, or t
  misc_feature (553)..(561): n is a, c, g, or t
  misc_feature (564)..(564): n is a, c, g, or t
  misc_feature (567)..(567): n is a, c, g, or t
  misc_feature (570)..(570): n is a, c, g, or t
  misc_feature (572)..(577): n is a, c, g, or t
  misc_feature (580)..(580): n is a, c, g, or t
  misc_feature (583)..(587): n is a, c, g, or t
  misc_feature (589)..(589): n is a, c, g, or t
  misc_feature (593)..(595): n is a, c, g, or t
  misc_feature (597)..(604): n is a, c, g, or t
  misc_feature (606)..(606): n is a, c, g, or t
  misc_feature (609)..(609): n is a, c, g, or t
  misc_feature (612)..(615): n is a, c, g, or t
  misc_feature (618)..(618): n is a, c, g, or t
  misc_feature (621)..(621): n is a, c, g, or t
  misc_feature (625)..(627): n is a, c, g, or t
  misc_feature (629)..(637): n is a, c, g, or t
  misc_feature (639)..(639): n is a, c, g, or t
  misc_feature (642)..(645): n is a, c, g, or t
  misc_feature (647)..(649): n is a, c, g, or t
  misc_feature (651)..(654): n is a, c, g, or t
  misc_feature (657)..(657): n is a, c, g, or t
  misc_feature (659)..(659): n is a, c, g, or t
  misc_feature (662)..(669): n is a, c, g, or t
  misc_feature (671)..(671): n is a, c, g, or t
  misc_feature (673)..(673): n is a, c, g, or t
  misc_feature (676)..(676): n is a, c, g, or t
  misc_feature (678)..(678): n is a, c, g, or t
  misc_feature (680)..(680): n is a, c, g, or t
  misc_feature (683)..(683): n is a, c, g, or t
  misc_feature (685)..(686): n is a, c, g, or t
  misc_feature (688)..(688): n is a, c, g, or t
  misc_feature (690)..(691): n is a, c, g, or t
  misc_feature (693)..(700): n is a, c, g, or t
  misc_feature (702)..(702): n is a, c, g, or t
  misc_feature (706)..(708): n is a, c, g, or t
  misc_feature (710)..(710): n is a, c, g, or t
  misc_feature (712)..(714): n is a, c, g, or t
  misc_feature (716)..(716): n is a, c, g, or t
  misc_feature (719)..(723): n is a, c, g, or t
  misc_feature (725)..(725): n is a, c, g, or t
  misc_feature (727)..(727): n is a, c, g, or t
  misc_feature (729)..(731): n is a, c, g, or t
  misc_feature (735)..(735): n is a, c, g, or t
  misc_feature (740)..(740): n is a, c, g, or t
  misc_feature (742)..(744): n is a, c, g, or t
  misc_feature (746)..(746): n is a, c, g, or t
  misc_feature (749)..(749): n is a, c, g, or t
  misc_feature (751)..(751): n is a, c, g, or t
  misc_feature (753)..(755): n is a, c, g, or t
  misc_feature (757)..(759): n is a, c, g, or t
  misc_feature (761)..(761): n is a, c, g, or t
  misc_feature (763)..(763): n is a, c, g, or t
  misc_feature (765)..(765): n is a, c, g, or t
  misc_feature (768)..(773): n is a, c, g, or t
  misc_feature (775)..(776): n is a, c, g, or t
  misc_feature (778)..(781): n is a, c, g, or t
  misc_feature (783)..(783): n is a, c, g, or t
  misc_feature (785)..(788): n is a, c, g, or t
  misc_feature (790)..(793): n is a, c, g, or t
  misc_feature (795)..(796): n is a, c, g, or t
  misc_feature (800)..(800): n is a, c, g, or t
  misc_feature (802)..(803): n is a, c, g, or t
  misc_feature (805)..(806): n is a, c, g, or t
  misc_feature (809)..(809): n is a, c, g, or t
  misc_feature (811)..(812): n is a, c, g, or t
  misc_feature (814)..(815): n is a, c, g, or t
  misc_feature (817)..(817): n is a, c, g, or t
  misc_feature (819)..(820): n is a, c, g, or t
  misc_feature (823)..(825): n is a, c, g, or t
  misc_feature (827)..(827): n is a, c, g, or t
  misc_feature (829)..(829): n is a, c, g, or t
  misc_feature (831)..(834): n is a, c, g, or t
  misc_feature (836)..(836): n is a, c, g, or t
  misc_feature (839)..(841): n is a, c, g, or t
  misc_feature (843)..(844): n is a, c, g, or t
  misc_feature (846)..(846): n is a, c, g, or t
  misc_feature (849)..(851): n is a, c, g, or t
  misc_feature (853)..(853): n is a, c, g, or t
  misc_feature (855)..(856): n is a, c, g, or t
  misc_feature (859)..(859): n is a, c, g, or t
  misc_feature (861)..(861): n is a, c, g, or t
  misc_feature (863)..(864): n is a, c, g, or t
  misc_feature (866)..(866): n is a, c, g, or t
  misc_feature (869)..(870): n is a, c, g, or t
  misc_feature (872)..(873): n is a, c, g, or t
  misc_feature (875)..(876): n is a, c, g, or t
  misc_feature (881)..(883): n is a, c, g, or t
  misc_feature (886)..(887): n is a, c, g, or t
  misc_feature (890)..(890): n is a, c, g, or t
  misc_feature (892)..(892): n is a, c, g, or t
  misc_feature (894)..(896): n is a, c, g, or t
  misc_feature (899)..(901): n is a, c, g, or t
  misc_feature (904)..(904): n is a, c, g, or t
  misc_feature (906)..(906): n is a, c, g, or t
  misc_feature (908)..(916): n is a, c, g, or t
  misc_feature (918)..(918): n is a, c, g, or t
  misc_feature (920)..(920): n is a, c, g, or t
  misc_feature (925)..(925): n is a, c, g, or t
  misc_feature (927)..(929): n is a, c, g, or t
  misc_feature (932)..(932): n is a, c, g, or t
  misc_feature (934)..(936): n is a, c, g, or t
  misc_feature (941)..(941): n is a, c, g, or t
  misc_feature (943)..(947): n is a, c, g, or t
  misc_feature (949)..(949): n is a, c, g, or t
  misc_feature (951)..(951): n is a, c, g, or t
  misc_feature (953)..(953): n is a, c, g, or t
  misc_feature (956)..(956): n is a, c, g, or t
  misc_feature (958)..(962): n is a, c, g, or t
  misc_feature (964)..(965): n is a, c, g, or t
  misc_feature (967)..(967): n is a, c, g, or t
  misc_feature (969)..(969): n is a, c, g, or t
  misc_feature (971)..(973): n is a, c, g, or t
  misc_feature (975)..(975): n is a, c, g, or t
  misc_feature (980)..(981): n is a, c, g, or t
  misc_feature (988)..(988): n is a, c, g, or t
  misc_feature (1361)..(1361): n is a, c, g, or t
  misc_feature (1418)..(1418): n is a, c, g, or t
  misc_feature (1430)..(1430): n is a, c, g, or t
  misc_feature (1667)..(1667): n is a, c, g, or t
  misc_feature (1736)..(1736): n is a, c, g, or t
  misc_feature (1976)..(1976): n is a, c, g, or t
  misc_feature (1985)..(1985): n is a, c, g, or t
  misc_feature (1988)..(1988): n is a, c, g, or t
  misc_feature (2003)..(2003): n is a, c, g, or t
  misc_feature (2012)..(2012): n is a, c, g, or t
  misc_feature (2378)..(2378): n is a, c, g, or t
  misc_feature (3355)..(3355): n is a, c, g, or t
  misc_feature (3686)..(3686): n is a, c, g, or t
nanncnnttntncnnntttnncccnnnttncncntnngnnannnccnaannngnnntncnngngngggganananannnnnngnggnnnaananntncnnnnccnaangncnnnnntnggcnccnngnnccncnagcnnanngnnttntncnctctctcnnannnccncntgnnccnntttgngnnanantngnnnnnntannngngngngngnnanngnaannnnnncngnntnnnnaananannnnttnncccnnaantnnngcncntnnanantntnnncnctnngnttnttnncnnnancnnnnnnnanngnnnntnnnnnnggnnaanngnntncgcnnngnntttnnngnnccnnangnccncnnatnncngnnntcnnnntnncnaanaannnnatnnccgnncncncncnntnnntntnnncnnnnanttnttgngcnctcnccnnnncncnanccanannnctttncnntncnnggcncnggnnannnntnnccnnntnnnttnnnttnnnntnnanannnnnnannnnnccnggntnngnntnnnnnnnnnttnccncangnnnnnnaanttnnnnntntttnnncnnnnnnnncnaanttnnnnggnttnggtnnnannnnnnnnnanccnnnntnnnannnnttncnccnnnnnnnncncnaangngnggncnntnanngnnnnnnnngnaatnnngngnnncnccnnnnngncntnnnggangcgtntnnntnccnancnnncnnncncngnaannnnnntnncnnnnanannnntnnnngnntttncnnanngcncnngnnantnnccnnncncncnnnngngcnnngnnanaannntntnnccntncnntnggnncnntnnggagnnnatnnccntntnnnttnnnttntntnnnnnnnnnananttttngnnnttntnnntttcncnnnnntntnanaantnnnnngnncngncnnncnaattnncccccanccataaaaggatgtgatgggcgccatgatcttaactatggcttctgattggcgcccctttcgagcgacctctctccttttttggagaagcatcgcggcgaggggaggcgggaaatgcctcgccatctgtgaacagggaagagcgagcaacccggtgcttttcgatgagaaccgcaagacggtcacggtcaacaggcttgatcatataattggacgcgcccagttcaaatcccatggattcattgtctacgaccgttaccataatcaccgggatctctgccaattcaggatccgctttcaactgattcagaacggcccaaccatcacagtccggcataatgacatccagcgttacaacgagtggcttcacttgnttggccagacgcaaaccttcttcgccactcgcggcggcgaccacgtgaaaccctagnctcgtcagaaancgggacatcaggtcgcggaccgtggagtcatcatcgatcaccaggatggtatccaggttcgatttcgtctccagggagatggccggaggatcgttggtcttctctgtctgcgtgccttcggctatctctgtcgtgactttggctggaagatatacggtaaagacggaaccctgacccggctcactctcgacggaaattcggcccttcatcaatcggacgtaccggtaactgatggcnagtcccaagcctgtccctccgtacttcctggctatggagacatccgcctgggtaaactcttgaaatagntttgtcttctgtttcggagtgatcccaatgcccgtgtcggtgacacggaaccggatccagtcttgaccttcgtccatgctcctatccacacccactgagattgtgccgtgctccgtgaatttgcacgcgttgctaagcaagttgaataagatctggcggaccttcgtgatatcggctcgcattactcccagttcctctgccacgtggacctggatagcattggagttcttcgatatcgcnggatgaagngtngtaaccatttcgttnatcatctgngatatatcgaaggtttcaagatgcagccccatcctcccggcctcaatctttgataagtccagcacatcattgatcagggacaataagtgtttccccgctccctgaatcttttgcaaatccttgacgttctctaacttgcccaattcgtgtgtttcttcctccagcatttcgctataaccaatgatcgcgttgagcggagtgcgcaattcgtggctcatattggcgaggaatgcgcttttggcgcggttcgcatcctcggctgcgtgctttgcattgagcaactcctgctgcatctccttgcggtggactatttcgccttccaactccatggtcctggtcttaagctcatcgttggcgtggtgcaangccgtatcccgatgctgaatttcggacaacatcgtattgaacccgtcgatcagccttccgatttcgtcgccgtaaaatttggtggctcgaacttcgtagctttttgtggcggaaaccattctcatcgtgtcttctaggtgcaaaatgggcccggaaatcaatttctggagcttcgaagacacgaggagtgcaaagaagccggagatcagcacgaaactcaagaagatgcttgcatatcgtttggcccgcaaattccattggcgcatgtccgactgcagaaatagagttccgaggggttccccttttagagcgacgtcgcgaaagacttccagataacttgcttgaaaacgataacctctttcctgcggaggggcaggaagaggtggcgggggggcgttcgcgtgagaatagttggcgaagatttttccgtcgcgtgtatataacacagccgatacgatgtcttgcttggcctggagggccgacaacgttacggtcgcggaggcttcgtctttaaaagccatcgccgccgcgctgttatacccaataatatcggcctgcgtcatcagatcctggctcaatgaattgcgaaatgaaattaggtcgtaaatgagaaagcctgcggaagacagaaccacggcgacgccactcgtcagcatcgtgatcagcatcagttttcgcttgatggagagatctttcagattcattcgggcttcctcccatcagccgcggcctgttggacgattctagccagtgtcagcagcctggaactgatggtcaggtctgcgtgcttggctgcctcgacgttcacctcaaaacgaaccttattgtcctccaacatgaaattaatgatgccaccgcgcttggcgaaacccggcgcgtccccgattgtcaaaattggcagacctttcatcgcgtcaatcacactctcgatgtgttctttttccgacgaacttacaaacaagatgttgcagtccctnagatctttgaaatcccggctccatttcaccctcttgaccgcaaagccccgtccgttgattttcttgtcagcgacgatcctgtcgagggtcgccccaaagggatcctcccctagaatacctatcacaatcggggaatccggctgggcaaaagaggccgtgggccattccactaattttgcgaaattgtaaataaagccagccttgatcaaatattccgaggaatcggaagagtccaatgcttctgcatggcctcccaaggccatggcggacaacagacaggttatgccgatcagcaacccaacttttttcatgaaccctttgcctgcctatncattaagtccggctcctgagagcccactcgccacactactcaaatctccaggtaatggttccccggaaggtgcgcgccacccgggtgggtattgtgttgataaattccggaataaactccacgtgccgcttattcagcaagttttgcccgccaacggagagctccaggtgtgcaattggcttccagccgagttgagcatccaaagagtagtagctgggtatattgagacttgaaagccgatccacgtatcgaacagttaagtcctgctccaaatgcataggcaagtctaacgaggacctcacataccattgatg

SEQ ID NO: 1637 - DNA, 4000 bp, Escherichia coli
  misc_feature (51)..(51): n is a, c, g, or t
  misc_feature (153)..(153): n is a, c, g, or t
  misc_feature (162)..(162): n is a, c, g, or t
  misc_feature (606)..(606): n is a, c, g, or t
  misc_feature (616)..(616): n is a, c, g, or t
  misc_feature (648)..(648): n is a, c, g, or t
  misc_feature (789)..(789): n is a, c, g, or t
  misc_feature (791)..(791): n is a, c, g, or t
  misc_feature (930)..(930): n is a, c, g, or t
  misc_feature (942)..(942): n is a, c, g, or t
  misc_feature (984)..(985): n is a, c, g, or t
  misc_feature (987)..(987): n is a, c, g, or t
  misc_feature (1122)..(1122): n is a, c, g, or t
  misc_feature (1185)..(1185): n is a, c, g, or t
  misc_feature (1272)..(1272): n is a, c, g, or t
  misc_feature (1467)..(1467): n is a, c, g, or t
  misc_feature (1473)..(1473): n is a, c, g, or t
  misc_feature (1557)..(1557): n is a, c, g, or t
  misc_feature (1995)..(1995): n is a, c, g, or t
  misc_feature (2045)..(2045): n is a, c, g, or t
  misc_feature (2049)..(2049): n is a, c, g, or t
  misc_feature (2078)..(2079): n is a, c, g, or t
  misc_feature (2279)..(2279): n is a, c, g, or t
  misc_feature (2392)..(2392): n is a, c, g, or t
  misc_feature (2663)..(2663): n is a, c, g, or t
  misc_feature (2851)..(2851): n is a, c, g, or t
  misc_feature (3289)..(3289): n is a, c, g, or t
  misc_feature (3334)..(3334): n is a, c, g, or t
  misc_feature (3561)..(3561): n is a, c, g, or t
  misc_feature (3610)..(3610): n is a, c, g, or t
  misc_feature (3613)..(3613): n is a, c, g, or t
  misc_feature (3622)..(3622): n is a, c, g, or t
  misc_feature (3658)..(3658): n is a, c, g, or t
  misc_feature (3772)..(3772): n is a, c, g, or t
ggagtgaaggtgaaaacacgagtaaaatattggtctaacgagaacgaagangtaaacttcaagcctttaaggatttgatagttcaaacctaagctcaatctcacgttatagttagagttggttttatcgatatcacgcaactgcttaagggcntctttttcngcaatacttcctttaccagggagcacagttggggttcgtttagggtcgaaagtaagaccttgaacacgtcccatatccgagccagccttttgagttgtgtaggttaagttaattcttgagtataagcttaactttgtagataggttgaaatccaagttggttaacaagctatatctgcggaagttagagctaatcatgatacctgtttcgtcgtaaataccaccatttacaagatagcgcacattttctgtaccgcccgaaagctgtacatcagccttagtaacacgtccaactctgaaggcatatttccaccagttggttctattattatagaaggtgttcaacgagtcttgtgcaattgaaggcaaacgacggtcgccttccaccacattaccatttctccaaaggtagtcgtaagcaccatctccgtcgatatcccagccntatgagtctntataagacttgggatgaacaaggttatcggtnatataatcatagtgagaagtgcgttgttgctttgccattagcaatgcaatgtctctttctcctttacctaagatttgcactggagtacttggtagccacgaaagcgattgcgaaacgttgatattcacttccgacttaccngncttaccctttttagttgtaaccaagatcacaccatttcctgctctcgaaccatacaaagaagccgaagcagcatctttcaacacttgcacactctcgatacttgaggggtctaagcccgacaatgggttgatacctccngtgctttcagangatccactcgttacaggtacaccgtcgataacgaacaatggnntnccatcgttcacgcctttttggttcaatgagctaaaaccacgaatcgtaatcttcgatcctctaccaccaggagagcccgaaaggttggtaacatccacaccagctacacggccttgaagaaggttttcgacactnggtgaaggtgttttttgtaggtcttcggctttaactgaaccgatagcacccacttgttcacgngtatttcgtttaccataagcaataaccgacacctcgcccaccatgtaagcagatgaaggaagggtgatggttaatggtttattggcntcgtatttaatggtttttgtttcgtaaccaacgctcgacacagttacatcgccatgctctttgtctacaagaagagtgaagttaccatccatgtcggcacttgttcctaccgaggtgccttttatttgcaccgttgcaagtggaataccgcctccatctttgtcttttaccaagcctttaagggtgaatttgccngctgcnttcttttgcattttgaacacattgatagcctttccctctacgttgtaggtaaagggtgtgccctttaaaacgctttgaatggcnctcaactcatctacgttatcgaatgatatcgtaagagttagcgagtcgtttttcacatcatcggtgtaattcaccttgtactcgcccttgctagataagaaatctaggatgtaagcaacgctcttttctttaaaagaaatagagaaatttttgtttaatacttgtgctcccgcattcaaaggattagaaaaggataggagaacagcattaaataaaaacaagaaaaatagattccttgttttgtttgatgcactctttcttgtcattaatgattactttttggttacgaagtctcggtttatcttgtggtatcactacggaaagaaaaactcaaagaaattctttaatattaaaaattttcgattgcaaaaatacgaaaaaactacaacaccttattatttttagtgagagattatcaaaaaaaatagccttctaacntctattttacacattcttaatactaaaaaagataagttcttgattattgncccnttttatttataatttaacaacctttcaanntgcccccaatagcagtgcttttttgcttcaatttcattgctttttcagtgtaaaagaagtgcttttgcgccccaaagtcaatgcttttctggcacgagcagataacactctcaccacaagtgctttactcattcgtggccttgctaaaggttatcgctcttttctgttgtgtagcaaataaaaaataactaactttgtanaattaaaccacgtcttaactatggaacaactgctacactacatttggaaacacaagctattttcgctctcgcaactcgttacgactgagggcaaaaacgttgaaataatcgancaaggacggcacaacaccgacgctggacccgactttttcaatgctaaaatacgaatagctggaaccgaatgggtgggcaatgtagagattcattgtaaggcatcggaatggtttttgcatcaccacgacaccgacgaacgctacgacaacgttattcttcatgtgtgtggtgagatagacgacattgcaacaacgagcaaagggcgacaaattgagcagacaattctgcccattcctgcccccatcgaggcgtgttatcaagagctaatgncgcctcacaactcgcctgctccatgctatctgcatgctgccaacatgcctaaaattaagcaaagagcgtggctcagcgcattgcaaacagagcggttagaacgcaaaacgaaggcgatctttgagcgactcgacaagtgtaacaagtcgtgggagcaggttttcttcgtaacactcgcccgaaatttnggctttggcatcaacaataacgcctttgaagagtgggctttcaatgtgcctttgcacgtaattgaccatcatagagacgatttgttgcaggtagaagctttgttcttggggcttgcaggcttgttagacgagggtcagatgaatgacgaacagcgtcaaagagtggcgaacgacgcctattttgcaaggctcaaacaagagtataactatctttcgcacaagttttctctctcgtgtatgagggcttcgcactggaaattcttgcgtcttcgacctcaaaatttccctcatctgcgcatcgctcagttggcaagtttgtatcatctgcgccaaattgggttgagatcgatgctcgaaagcaaggacattgcctctattcaaaagcttttttgctttgaaacgagcagttattggcaacaccactacacgttcggaacnccctcgcaaaaggggtctaagcagctttctaaaggctcgataganctcattatcatcaacaccatcgtgcctttgctgtttgcttatggcaaatatagcaacaaagcggaattgtgcaacactgcactcgacttgtgggaacagctcgaacccgaacaaaaccacatcgttacgcaatggaaaaagagtggtttttgcatcgaatcggctgccgacacgcaggcacttattcagcttcacaacgaatattgcgccacgaaagattgcttganatgtcgctttggcttcgactttctgcgctcttgcacggcaaccaacaanaantgagatatnaatttaaataagataaaaatggaatatgtatttacnatgaagatgagcgttcgtgactatgaatgcgacttgcagggtattgtgaacaacgctaactatcttcactacatagaacatacacgacacgagttcttaaagcatgcaggggcnaactttgcagagcttcatcaaaacggaatagatgcggttgtggctcgcatgaacctacaatataaaacgccattgcgcagcgacgacaccttcgaatcgtgcctcaacctcactaaagagggtattcgttacactttttatcaagacatctacaatgccactacccgccaattgtgctttagagccagtgttgatgtggcgtgcattgtgaacaaccgacttggaagg

SEQ ID NO: 1638 - DNA, 4000 bp, Escherichia coli
  misc_feature (1877)..(1877): n is a, c, g, or t
  misc_feature (1986)..(1986): n is a, c, g, or t
  misc_feature (1990)..(1990): n is a, c, g, or t
  misc_feature (2003)..(2003): n is a, c, g, or t
  misc_feature (2021)..(2021): n is a, c, g, or t
  misc_feature (2024)..(2024): n is a, c, g, or t
  misc_feature (2027)..(2027): n is a, c, g, or t
  misc_feature (2030)..(2030): n is a, c, g, or t
  misc_feature (2033)..(2033): n is a, c, g, or t
  misc_feature (2036)..(2036): n is a, c, g, or t
  misc_feature (2051)..(2051): n is a, c, g, or t
  misc_feature (2054)..(2054): n is a, c, g, or t
  misc_feature (2712)..(2712): n is a, c, g, or t
  misc_feature (3043)..(3043): n is a, c, g, or t
  misc_feature (3399)..(3399): n is a, c, g, or t
cgtcgccgcagtcctcgaggtagtctgtgtgctctgtagcagcacccagtggtacggtgtccttcgtggcttcgtcgcttcgtcgtttctttgtggcgcgctctgtagcattgccgtctgcatcggattcggtgtttgtggcgcgctctgtagcattgccgtctgccttggactcgtctgcatcggattcggtagcattgctgcttgcttcggagtctgtgtcttcaggtggcggctgtgggatcaggaatgtgtgcatggctgtcgcttccgtgcgtccagtggcccgactggcgcacaagagtccttggtcgctcgtgctgtggttcaacatacgcttgcactcgtgcatcatggcgatgcccttgccagaaaaaactttgaggttgtgttctgtcttcacacagctcgctcctgtcgccagaaacacgccgagctcgcaagcggagaaccacatcgtgcggttggcacagaatatgaaccgacgtatccttagcctggctcgttggatcagagtggtctctgctgcatctggctcattctccgcggcgacgatgcggcgcatacatgcagcgaacggttgcatgacggggccgagagcctcttgtgccttggatgcatatttggtcatgtagaaatctgcgacgtgggctgctcgcatcgctgtcgcaagtgtgttcatgatgagtctgcctgtggcgccaatgcgtctgccgatgccgcacaataatggcatagtgggtctggaggtgccggtgtgcgacggagaatcctgctctgtagcatggacgtctggcactgatctcttctggtattgcttgtcggcgttgcagcggagggtggcctgtagcacgtcgtctgacgatgatctgaacggcgaatcccgtggtaccattgacttaccatactcgttttcatcgttgcctgtggcaatgaacgctttcttaacgatttccttgccgcgtcttatgacatacttgatgaatccagcaatgctgagggcaacgtggcggtagaatctgaagcgacacttgggcacgccagggccggagagtttttggccgcttcgctggggtggccctgcagcactttcctttttcttcttctcgtatttgacacatgtgccggtgcagtcgtgatcgtggttctgaatgaagcatgctctctgatctctcgcaaagcttgtgctccatgctctacaatcgtcgtggatttgttcaggtgttgcctcctcgccatctggtgtacgaaaacctgtcacctcaccgctcgagtcgacgacatattctttaccatgtggaagccatccgctgttgtctgtgcgctctgtagcaacactcgggtagtagccatactcgtcgggtacctcaacatggccgaagctgtcggagcgccggtacatgggcatcatgctctgggtggcaccggtgagtgggagctccttgtaggggttccgcattggccgctgctgtgtgatcgaatttgcttcttcggtcctgatgtggccattgggctcccgctcagttactgcaatgaatggacggagcggcgcattgtcgtccgcctcctccacttggccatcgaacctgctgcgtttctgctgttggggtgtgaacggttctggtcgcagtgtgactccgagttgggtcccagtgagcactgcagagtcatattgcaaagtgcatgcggcccgcagcacggcgtcccgcgtctgttggcaccaccgggtcagctcttcctcgccacgctctgtagcattggccgcgaaatcgccacgctctgtagcattggccgcgaagagctgcttcagtcgcgccgcccgtgttctaggcacggagatgactttttcgtggccatgcgtgaagccacgtccttgngcctccaagggtttcaacgcggaacgcgggatttcagctatgccaatctggccggtgcttgcgaagtcgtcctctcgggcaggctccgcatctcggtggccgtactttntcangccaatgaaagcnttcatgcaaagcagctcngantgnacnagntcntccattagaaggaanagncgcacttgtagcattggatgtttggccaatgcccggtgcatggcctgcagtgtgggcatgcacggaacgctgtgtagtagattgacttctcgcttgcccaggggctggccggctccgttcatgagcgtgactgtgatcggtgaatagatgtcggcaaaattcgtagtgaggaagattgtcagtgggccatcatatatgttgagcgcgaagcccagctgtcgtaagccaactttgtaaccctgcgtcagaggtatgttagctgtctggaatgtgatgtactggagtgccttgaacagtggcagcaatttatgttcagcagctgctcgcatcatctcttgcatgctctgttggccgtggcgcgcaaggatggcggtgagcttctcgaagtgctctaccttcgcatcgcatattgtttgcatgtctatgcgccatttcggagcgttgcccttccacatatgttgggttgtttgtagaatggctaccttcctgacggtatctgcgaagatggccatgaactctggggtgttccatcgagattgtggtggtgctctgtagcagccttcagggatgagtgggtcatcggcgtctgattccaagctatactcgagttcttcgcgattcgcaaggtagttaaagagttctcgcattccaatcctcnttggtcggtccaaatttggagcgcagtccccatagaagaactgcacaaacgcagcactccacgcaggtgcctggaacatgttcatcggcttccctgacttgatgtgcaatgttccgggggtgttggcctcggtgccctccatgcgcgcggatgcaagagcatcctccattttcttttggtactcgccacccatcttgtgagcaagtcttctcaattctactaatgcagagccatgtgtggctttctccgcagccagggcagtcgcggcgacgagagcttcctcgctgtccgtgcttgctgcgtgcagacgccgctggtgggcctggtgtangcgtttgccactttcttgtaccagttccaaattcttctgaaagacgatcatgagatcaactggatcgtgagcgtcgctatcctgtattccaatacagaactccgccggcaggtccagtggcaatgcctcggcatcaactttgtctgctgtcgcatccgggccgtgctctgtagcagcggcgtcatcatcgtttaggccgtgctctgtagcatcgattccatcgccgtcgtttacaacttgtccgtcgttgtcgttcgatggtagtgtgcatgtggatgctttcatggctgccggtccatcgagggtcggattgaatgtgtgtaaagtatccattccaattgcagactgcgtgatgnctgtgggcaccgctcgctcgggccactgggtgcgagcttgttctgcgtctatctccactccagcaaacaccgcgtttacctttttgcgatactcggcgcatctaatgtatctttctgtatctatctccagtgcgctgtgtttgccaacgtcggctgctgtcattgtctggttgttgaaacataccgacaggtatttggagatttctgcatctggtggagggagcttctgcatgatttcctctgggcgtggctgggtcagcagaattgtattgcctacgaaacccttctcctgatcatcactgtgctcgctgtatcgcaggactatcagtctacagaccatgattgcaagtccgagaagagattgcatggcaatgctgagattgtagaagagtggatgtactcggccgccccagttccagttggctaacgcaaagaaaggcatgaggggctctggtctgcagagggcagtcgtgcatgacttgcatagccacactggctcgcccgatgcaccgatgcctgcacaccttggtagttgatgctctgtagcagtcgtagcggtggcttcggctggtttctgcatgggcacccttcgcgtgttgag

SEQ ID NO: 1639 - DNA, 4000 bp, Escherichia coli
  misc_feature (1616)..(1616): n is a, c, g, or t
  misc_feature (1985)..(1985): n is a, c, g, or t
  misc_feature (1994)..(1994): n is a, c, g, or t
ttgagttacttttttcaagaataagaagttgatcaaacccaataccaaaatgacgatcagataatcttttaattaatgattttgataaaccaaattgtttttctctttggtcaatgacaatgaagtcatttccggtgccctgcatttttgtaaatttcataattatctttttgtcttgttttttgatattctagctctttttaaagaactataactatgaaagactatctatttacatcagagtctgtttccgaagggcatcctgataaagtcgcagatttgatatcagatgcgattttagatgcgattttggaacaagaccccgttgcgagagttgcggcagaaaccctgacaagtacaaatttagttgtacttgggggagaaatttcaacaacagcaaaagttgattatgagcaagttgtccgtgaaacccttaaatttattggctatgacaatattgactacgggattgattataaaacttgtgaagtattaataaaatatggcattcaatctcctgatatagcccaaggtgttaatggggcatttgacgaccctctggatcaaggtgctggagatcaaggtcttatgtttggttttgcatgtaatgaatctgatcaattgatgccacttccaatacatcttgcacatcgcttggtggagcgccaatcagttactagaaagaaaggggttctaacttggttaaggccggatgctaagtcacaagttaccatgcactataaggacgggaaaccagaaagaatagacacgattgttctttccacacagcatgcgcctgaagtttcccttaaagatttaagagaggctgtgattgaagaaattataaaacctgagattcctaaagatcttattaagggtgaaattaattatttaatcaaccctactggaagatttgttattggtggcccacaaggggactgcggattaactgggaggaagattatagttgatacctacggtggagctgcccctcatggtggaggtgcattttcaggaaaagatcccacaaaagtcgatcgatctgcagcttatgcggcaagatacgtcgcaaaaaatatcgtcgctgcaggtttggctgataagtgcctagtgcaggtgtcatatgccattggtgtggctaaaccaacatccattatggtggatagttttggtacagcaagagtatcagattcagagctttcaaatattgttatggataattttgaccttcgtcctaaaggcattgtaaatatgcttgacttattaaggcctatatatagaaatacggcagcctatgggcattttggtagaacagaacctgaattttcttgggaaaaggtcgataaaaaaggtttaggttgaatttgaaaacttcataagctcttgatttaacgtgagttatgatttaacattcttacttccaaggaacgttgcgagattattcaatcccaggcttggattacaaataataaatttgtaacgacgttcaccatttaccgtaccagagcgggataataggtgaacaaaatccctactggtcacaattttatttaaaggaaaataaattgaatacagtgactgatgtaaataataaaacaaaaaacttcgtagtctcngatataaagctagctaaattcggcaggcaggaaattgctattgctgaaacagaaatgccaggcttaattggtataagagatgaatatgcttcaagccaacctttgaagggagcgcgtattagtggctccttacatatgacaattcaaacggccgttcttattgaaacgcttgtggcattgggagctgaagttagatgggcatcatgtaacatttactcaacacaagatcatgcagctgctgcgattgcagaaggtggaacacctgtgttcgcttttaaaggtgaaagtctcgatgaatattgggaatttacgcatcgtatttttgagtgggaaagtggaaaattttctaacatgattttagatgatggnggagacgcnacacttttacttcacttaggtgttaaagctgaaaaggatatttctgttcttaataatccaaactcagaggaagaaacatgtttattttcggccatcaaaggtaaattaaagaataatccaacatggtattcagacaaaattggccatataaagggagtaactgaggagactacaacgggtgttatgaggctttaccaaatgtttcagaataaagaattgagtttcccagcaattaatgtaaacgattccgttaccaaatcaaagtttgataatctttatggctgtcgtgaatcattagtagatgctattaaaagggccactgatgtcatggttgccggaaaaatagcagttgttgcaggttatggtgatgttggtaagggctcagcccaagccttaagagcgctatcagctcaggtatgggtcactgaaattgatcctatctgcgcactacaggcagcaatggaaggatatcgagtggttacaatggattatgctgctgaacacgccgatatttttgtaagtgcaacaggtaattatcacgttattacgcatgaacacatgaaaaaaatgaaggatcaagcaattgtttgtaatattggacattttgataatgagattgatgttgcatctttatcaaattatgaatgggaggaaattaagccccaagtagatcatgttatttttccagataaaaagaggatcatacttttagcccaaggacgtttagttaacttaggttgtgggacagggcatccaagttatgtcatgggttcttcattcgcaaaccaaacaatagctcagattgagttgtttactcaacctgagaaatatcctttgggcgtgtatacattgcctaagcatttggatgaaaaggttgcagtacttcaattaaaaaatttaaatgctgagttaacaaaactcacacctgagcaggcaaagtatattgatgttgatgttactggaccttttaaaccagataattatcgttattaggagaatttgatggcgaatcttcccccgttaagttttgaattttacccccctcaaacacaagagggggtaaataaacttaagcatacagctaaagaacttaataagtataaacctgatttcttttctgttacctttggtgcgggtggctcaacaaaggagaggaccttagatgctgtttttgaactgagtaattcagattttaatgtagcacctcacatttcttgtatctcatcctcaaaagtagaaattaaggaattattggatcaatataagtcacaaaaaataaatcacttagtcgcgcttcgtggagataatccctctggggctataaactctggtgagtttaactatgccaatgagttagtaagatttattaagttagaaatgggagatgctttcaaaatagatgttgccgcttatccggaagttcatcctgaatcagaaagtgcaaaacaagactttataaactttaaaaataaagttgaggccggggccgattcagcaattacacagttcttttttaatgttgatgcttattttaaatttattgaagaatgtcagaagagctcaatcaatattcctatcgttccaggtattatgccaatttacaatagtaagcaactcattagatttgctaataattgtggtgctgaaattccaagatggttgagatttaaattagaagattatgcagatgatttagattcattaagggagtttggcgtagactttataagtgaattatctgaaacattgattcagaatggtgttcctggcatacacttttatacgataaattactccaagactttatcgaaaattataaaaaatatatcccaatcttagtgcagctctgcttgtttattttgatatatggagtcttcaacaaataggtaactattttcttttccgcttttccataaagtcatcataactatccacctcatttcttctatgttgatatatttctgattaagaatcataatttgatctaaaattatttcaaattcagt

SEQ ID NO: 1640 - DNA, 4000 bp, Escherichia coli
  misc_feature (1985)..(1985): n is a, c, g, or t
  misc_feature (1988)..(1989): n is a, c, g, or t
  misc_feature (1991)..(1993): n is a, c, g, or t
tctcgtcgatttacccgggtacgggttcgcgttcgccaagcaacaccgcgtagagtcgtggaacgaactgatggacaagtatctcacttcgcgcccgaacttaaagcgcgtatacttggtcatcgacgctcgccacggaatgaaagcatcggacagagaaatgttggcatttttgtccaagtacggcgagacgcagtgcggagtgattctgaacaaatgcgactacgtcaacccgaatgagttggcgcgtcgcgcgtacttgattcaagaagagcttcgttacaccaagcgtgctcgcaccatggtgctcatggcgtcaacatccacgggtgcaggcgtcacggagattgctcgcgaaatttacggtatggcgcttgacgatcccagtggcgaagaatacgacgacgacgacgacgtcgagagtgaatcagatggcgagtacggcgagggcgacgttggggacgacgacagtttcgccggaagttcaagtaaaaagacagagttttacggtggtgagtggaaacccggacaaaaagcttcgaagaagtacacgccagcgtcgaaggcagtgccggctgccggtcgtggcggtcgaggcggtcgaggcggtcgaggcgcgcagggcggtcgtggcgggcccagcggtcgaggtgggcgtgggcgaggcggacgggggcgaggcgatgatgcacgcggcgacgaggcgcgaggcggcggtcgaagcggcggtcgaagcggcggtcgtgggcgaggcaagggcttcacgcaaggcacgcccggaagcaactagcgagatttattgtttgtaacaaaccgagtgcgcgatacatgtattaaaactcccacgcgtggttaagttggaatgtcgggttttgcaaaccttgcgtagtgagcacggatttagccacgacttcccatcccttgagctcttccgtgaactcgtagccgacttggaattccatctcgcgagcggcgacgcgggtcagcgccttggcgctaaagtgcttggcgaactgccgtcgggcgctcaactccaactctacccctttatccgtcatgaagtttgccgctaaatcaaaatcacccttacgctgcgcccagcccgcgcgccagcaccctcccggtttgatgtcgagctgatcgtccgccgcggtgtgctgactgactctctgcacgcgcaagtcgccgtactcctcgtgcgtcgtgctgacgtcaaagtccaaatggtccatgctcaccgagtcgtgcaccatggtgtacttggcgttaatcgacaccccatcgatgtccatcttcgattccaacgccggattccacttcgtcttaccgttccaaggaaacggcggcgacggcgcgagcgccagcgtcggcgccttggccacgttgagtaatttttccaagttcaatctcgccttgaactgcatcaactctcccttgaacggtcgcgatttgaactcaatcccaaacgccccgatatcctctcgcgtcgtgatcttcgcgctcttcaaatcgggaaatctcgcctccatcatgctcctcgcccccgccaagtcaaacgccgcccgcgtcgtgctctcgtacgtgttcacatcgatcgtctcctccaccgccttcagcttgaaccacgtcgtctcgcgaatcaagtccttgacgcaatctccgaagcgctcgttcaaaggtttcagcaccttacccgccagcacgtcgcgctcgcggtgcaaatcgacaacctcgcgctgcagtcgactgatttctcgcgcctgcgcgcgcaactgtccttgcagcagcccgagcgtttgcgcggtgtcgtcgtcgatggacgacgcgcgggacgcgcggtgcatcgcgacggatcgtttgtcgcgcgcgcgacgcgcggtgacgacgacacacgcgggcgacgcgtgggacgacgacgacgacgacgacgcgcgcgtcgcgtcgcgcctcgcgcgtcggatttggaaaatttaaattttccaaanccnnannncgctggggtttagggcgggtggtgagggcgcgacgttatccgcgtgcgtcgtatgggtaaacagtcgtgacgctttgcgacgctccgatcgcgccctcgcgggacgatcgctcgcgcgcgcgcgcgcggcacatttcagcgcaccgtcctccgcgacgcgccacgcacgaacgcacggaagactttacgcctcgcgaatccacgcgacgcacgacgctcgacgacgcacacagacgcggagacgactagatacccatcgacatgatcgctcgagtctccacgacctcgacggtgaccgcgcgcgcgtccgcgagacaaaacaagacggaacgccgcgacgccgcggtcgttcgcgcgaacgctaaggaacaagcgtgcgcggcggtgctcgcgatgacggtcatggcgagcccgttggcgaacgccgcggtcgaggtggctcaggtcgccaagggcgacacaaagtcgctcgcgagcgatttgttcgccgagcaacaaaccaagtccacgccggctgcgccgaagaagacgaagcaactcgcgtctccttcgatgccgaaggcgccgtccatcagcgcgccgtccttgccgagcttcagcgcgccgtccatttcgttgccgtccttcagcacggcgaagaagacggacgccaaggcgcccgcggccaaggaagcgcccgcgccgaaggcgaagaaggaatccggtgctggccctaacttggctctcaccctgctcgttctcttctcccctctcctcgccgtgcaagcggtctctttccaaactttcgcgcgcatcgcgaagcaaagtgcgggcaagtaagcgcgacgaagtgtttagcgccgaattcggcgtataaattggcggctttgataatattacatctcttattgagtacacatgaatacgctcgcctcaactcctccccggatttccgcgtttcgcgcggcgagcctcgcgaagccgcgcttgcgattctcgaagttgcctttgcgcgctgtccacgacagcttgaagctcatcgatctccacgcgagctcgttcgttgtcttctacctcggcgatgcgtaagcgtcgttcgcaatccgctgaatcgtcgttgcttttatcgtgaatacgcgcttcggcggcgaaaaagtttctcacgacgtcgacggcttcggcgctaggatcgcgcgcgatggcggctccgggcgctaactcgccgtttttcagtaaatgagcgtgcttgttcgcgaattcggctcggaattccgcctctgacaccttgggagaatcgacgaatttacgcttcgagcctggccttgattgagcctgctcggattgagcctgctgctggtaatgttccgcgatgatttcagaatacgatgagatgtcaaaattcgtcacggcgctcaaaccgcgatctgccacacacgccacgtcgtacgccaccgccgcctctacttcggtatcataaagtcccaaatatctgtacttcttgcctatcatctggccaattctcgcctcaaatttccccttggcgtgtttagtcacgcccctgaacttcgacgaaccttttgaaaatcctttgctctgacgccgcagactcaacactaagtcttccttcgaaatactctccagcgcgttcaactcattcgcataattacgaagatcgaaattggtttgtgctttcatgcctcgacatttgacagcgattacgtcgtacgcgatggccgcttgttcctcgctatcgaaaccgccgagatagacctgcttgcccgcgtcccagatgtgtgcttcgtagcgtcccgtgcggcaatgatgcgtaacgcctctagcgtcactagtacttcttacgtttcgtttttcaaccttcgccacgttcgggcgagagctccgtctagacggcgcctgtcgccgcttcggcgtctcgaggtcgagctcaggaagcccatggaataaatgatcaaagtcagcctgcaaagcgtccgtattcgtgttatcgagcattccaaagtcgaatggaaa

SEQ ID NO: 1641 - DNA, 4000 bp, Escherichia coli
  misc_feature (1)..(4): n is a, c, g, or t
  misc_feature (6)..(7): n is a, c, g, or t
  misc_feature (10)..(12): n is a, c, g, or t
  misc_feature (14)..(16): n is a, c, g, or t
  misc_feature (18)..(19): n is a, c, g, or t
  misc_feature (23)..(24): n is a, c, g, or t
  misc_feature (28)..(32): n is a, c, g, or t
  misc_feature (36)..(37): n is a, c, g, or t
  misc_feature (39)..(40): n is a, c, g, or t
  misc_feature (42)..(42): n is a, c, g, or t
  misc_feature (44)..(44): n is a, c, g, or t
  misc_feature (46)..(46): n is a, c, g, or t
  misc_feature (48)..(49): n is a, c, g, or t
  misc_feature (51)..(54): n is a, c, g, or t
  misc_feature (56)..(58): n is a, c, g, or t
  misc_feature (61)..(62): n is a, c, g, or t
  misc_feature (64)..(65): n is a, c, g, or t
  misc_feature (67)..(67): n is a, c, g, or t
  misc_feature (69)..(70): n is a, c, g, or t
  misc_feature (72)..(73): n is a, c, g, or t
  misc_feature (75)..(75): n is a, c, g, or t
  misc_feature (79)..(83): n is a, c, g, or t
  misc_feature (85)..(85): n is a, c, g, or t
  misc_feature (90)..(90): n is a, c, g, or t
  misc_feature (93)..(94): n is a, c, g, or t
  misc_feature (99)..(101): n is a, c, g, or t
  misc_feature (103)..(103): n is a, c, g, or t
  misc_feature (105)..(107): n is a, c, g, or t
  misc_feature (110)..(110): n is a, c, g, or t
  misc_feature (112)..(113): n is a, c, g, or t
  misc_feature (115)..(115): n is a, c, g, or t
  misc_feature (118)..(118): n is a, c, g, or t
  misc_feature (120)..(121): n is a, c, g, or t
  misc_feature (123)..(125): n is a, c, g, or t
  misc_feature (128)..(130): n is a, c, g, or t
  misc_feature (133)..(137): n is a, c, g, or t
  misc_feature (139)..(139): n is a, c, g, or t
  misc_feature (141)..(141): n is a, c, g, or t
  misc_feature (146)..(149): n is a, c, g, or t
  misc_feature (151)..(156): n is a, c, g, or t
  misc_feature (158)..(162): n is a, c, g, or t
  misc_feature (165)..(165): n is a, c, g, or t
  misc_feature (167)..(168): n is a, c, g, or t
  misc_feature (171)..(171): n is a, c, g, or t
  misc_feature (173)..(175): n is a, c, g, or t
  misc_feature (177)..(178): n is a, c, g, or t
  misc_feature (180)..(190): n is a, c, g, or t
  misc_feature (192)..(194): n is a, c, g, or t
  misc_feature (196)..(196): n is a, c, g, or t
  misc_feature (198)..(199): n is a, c, g, or t
  misc_feature (201)..(204): n is a, c, g, or t
  misc_feature (206)..(206): n is a, c, g, or t
  misc_feature (208)..(208): n is a, c, g, or t
  misc_feature (210)..(211): n is a, c, g, or t
  misc_feature (213)..(215): n is a, c, g, or t
  misc_feature (217)..(221): n is a, c, g, or t
  misc_feature (223)..(227): n is a, c, g, or t
  misc_feature (229)..(229): n is a, c, g, or t
  misc_feature (232)..(232): n is a, c, g, or t
  misc_feature (234)..(234): n is a, c, g, or t
  misc_feature (236)..(237): n is a, c, g, or t
  misc_feature (239)..(240): n is a, c, g, or t
  misc_feature (242)..(246): n is a, c, g, or t
  misc_feature (249)..(249): n is a, c, g, or t
  misc_feature (251)..(251): n is a, c, g, or t
  misc_feature (253)..(253): n is a, c, g, or t
  misc_feature (256)..(259): n is a, c, g, or t
  misc_feature (261)..(262): n is a, c, g, or t
  misc_feature (265)..(267): n is a, c, g, or t
  misc_feature (269)..(269): n is a, c, g, or t
  misc_feature (271)..(271): n is a, c, g, or t
  misc_feature (273)..(277): n is a, c, g, or t
  misc_feature (280)..(280): n is a, c, g, or t
  misc_feature (282)..(284): n is a, c, g, or t
  misc_feature (286)..(289): n is a, c, g, or t
  misc_feature (291)..(292): n is a, c, g, or t
  misc_feature (294)..(295): n is a, c, g, or t
  misc_feature (297)..(297): n is a, c, g, or t
  misc_feature (299)..(304): n is a, c, g, or t
  misc_feature (306)..(309): n is a, c, g, or t
  misc_feature (314)..(318): n is a, c, g, or t
  misc_feature (320)..(321): n is a, c, g, or t
  misc_feature (324)..(324): n is a, c, g, or t
  misc_feature (326)..(326): n is a, c, g, or t
  misc_feature (330)..(330): n is a, c, g, or t
  misc_feature (332)..(332): n is a, c, g, or t
  misc_feature (334)..(336): n is a, c, g, or t
  misc_feature (338)..(339): n is a, c, g, or t
  misc_feature (341)..(346): n is a, c, g, or t
  misc_feature (348)..(349): n is a, c, g, or t
  misc_feature (353)..(353): n is a, c, g, or t
  misc_feature (355)..(356): n is a, c, g, or t
  misc_feature (358)..(360): n is a, c, g, or t
  misc_feature (362)..(362): n is a, c, g, or t
  misc_feature (364)..(369): n is a, c, g, or t
  misc_feature (371)..(375): n is a, c, g, or t
  misc_feature (377)..(379): n is a, c, g, or t
  misc_feature (381)..(381): n is a, c, g, or t
  misc_feature (383)..(383): n is a, c, g, or t
  misc_feature (385)..(385): n is a, c, g, or t
  misc_feature (387)..(393): n is a, c, g, or t
  misc_feature (395)..(398): n is a, c, g, or t
  misc_feature (400)..(400): n is a, c, g, or t
  misc_feature (403)..(403): n is a, c, g, or t
  misc_feature (405)..(408): n is a, c, g, or t
  misc_feature (410)..(411): n is a, c, g, or t
  misc_feature (413)..(414): n is a, c, g, or t
  misc_feature (416)..(422): n is a, c, g, or t
  misc_feature (424)..(425): n is a, c, g, or t
  misc_feature (427)..(427): n is a, c, g, or t
  misc_feature (429)..(432): n is a, c, g, or t
  misc_feature (435)..(435): n is a, c, g, or t
  misc_feature (437)..(455): n is a, c, g, or t
  misc_feature (457)..(457): n is a, c, g, or t
  misc_feature (459)..(462): n is a, c, g, or t
  misc_feature (464)..(466): n is a, c, g, or t
  misc_feature (468)..(468): n is a, c, g, or t
  misc_feature (470)..(470): n is a, c, g, or t
  misc_feature (472)..(478): n is a, c, g, or t
  misc_feature (480)..(481): n is a, c, g, or t
  misc_feature (483)..(487): n is a, c, g, or t
  misc_feature (489)..(490): n is a, c, g, or t
  misc_feature (493)..(498): n is a, c, g, or t
  misc_feature (500)..(500): n is a, c, g, or t
  misc_feature (502)..(504): n is a, c, g, or t
  misc_feature (507)..(507): n is a, c, g, or t
  misc_feature (509)..(518): n is a, c, g, or t
  misc_feature (520)..(521): n is a, c, g, or t
  misc_feature (524)..(524): n is a, c, g, or t
  misc_feature (526)..(534): n is a, c, g, or t
  misc_feature (536)..(537): n is a, c, g, or t
  misc_feature (539)..(543): n is a, c, g, or t
  misc_feature (546)..(546): n is a, c, g, or t
  misc_feature (548)..(550): n is a, c, g, or t
  misc_feature (552)..(557): n is a, c, g, or t
  misc_feature (559)..(559): n is a, c, g, or t
  misc_feature (564)..(565): n is a, c, g, or t
  misc_feature (569)..(570): n is a, c, g, or t
  misc_feature (572)..(574): n is a, c, g, or t
  misc_feature (576)..(576): n is a, c, g, or t
  misc_feature (578)..(580): n is a, c, g, or t
  misc_feature (584)..(584): n is a, c, g, or t
  misc_feature (586)..(588): n is a, c, g, or t
  misc_feature (590)..(591): n is a, c, g, or t
  misc_feature (593)..(596): n is a, c, g, or t
  misc_feature (598)..(600): n is a, c, g, or t
  misc_feature (603)..(608): n is a, c, g, or t
  misc_feature (610)..(611): n is a, c, g, or t
  misc_feature (613)..(613): n is a, c, g, or t
  misc_feature (615)..(619): n is a, c, g, or t
  misc_feature (621)..(622): n is a, c, g, or t
  misc_feature (624)..(626): n is a, c, g, or t
  misc_feature (628)..(628): n is a, c, g, or t
  misc_feature (630)..(635): n is a, c, g, or t
  misc_feature (640)..(640): n is a, c, g, or t
  misc_feature (642)..(645): n is a, c, g, or t
  misc_feature (647)..(653): n is a, c, g, or t
  misc_feature (655)..(660): n is a, c, g, or t
  misc_feature (662)..(663): n is a, c, g, or t
  misc_feature (665)..(666): n is a, c, g, or t
  misc_feature (668)..(670): n is a, c, g, or t
  misc_feature (673)..(673): n is a, c, g, or t
  misc_feature (679)..(682): n is a, c, g, or t
  misc_feature (684)..(691): n is a, c, g, or t
  misc_feature (693)..(693): n is a, c, g, or t
  misc_feature (695)..(698): n is a, c, g, or t
  misc_feature (700)..(702): n is a, c, g, or t
  misc_feature (706)..(708): n is a, c, g, or t
  misc_feature (710)..(710): n is a, c, g, or t
  misc_feature (712)..(712): n is a, c, g, or t
  misc_feature (714)..(718): n is a, c, g, or t
  misc_feature (720)..(720): n is a, c, g, or t
  misc_feature (722)..(722): n is a, c, g, or t
  misc_feature (724)..(724): n is a, c, g, or t
  misc_feature (727)..(727): n is a, c, g, or t
  misc_feature (730)..(741): n is a, c, g, or t
  misc_feature (743)..(747): n is a, c, g, or t
  misc_feature (749)..(749): n is a, c, g, or t
  misc_feature (752)..(753): n is a, c, g, or t
  misc_feature (755)..(755): n is a, c, g, or t
  misc_feature (758)..(766): n is a, c, g, or t
  misc_feature (770)..(770): n is a, c, g, or t
  misc_feature (772)..(774): n is a, c, g, or t
  misc_feature (776)..(776): n is a, c, g, or t
  misc_feature (778)..(778): n is a, c, g, or t
  misc_feature (795)..(796): n is a, c, g, or t
  misc_feature (802)..(802): n is a, c, g, or t
  misc_feature (931)..(931): n is a, c, g, or t
  misc_feature (938)..(938): n is a, c, g, or t
  misc_feature (1104)..(1104): n is a, c, g, or t
  misc_feature (1287)..(1287): n is a, c, g, or t
  misc_feature (1378)..(1378): n is a, c, g, or t
  misc_feature (1383)..(1383): n is a, c, g, or t
  misc_feature (1389)..(1389): n is a, c, g, or t
  misc_feature (1392)..(1392): n is a, c, g, or t
  misc_feature (1401)..(1401): n is a, c, g, or t
  misc_feature (1415)..(1415): n is a, c, g, or t
  misc_feature (1419)..(1419): n is a, c, g, or t
  misc_feature (1425)..(1425): n is a, c, g, or t
  misc_feature (1431)..(1431): n is a, c, g, or t
  misc_feature (1461)..(1461): n is a, c, g, or t
  misc_feature (1470)..(1470): n is a, c, g, or t
  misc_feature (1473)..(1473): n is a, c, g, or t
  misc_feature (1509)..(1509): n is a, c, g, or t
  misc_feature (1517)..(1518): n is a, c, g, or t
  misc_feature (1524)..(1524): n is a, c, g, or t
  misc_feature (1536)..(1536): n is a, c, g, or t
  misc_feature (1539)..(1539): n is a, c, g, or t
  misc_feature (1545)..(1545): n is a, c, g, or t
  misc_feature (1560)..(1560): n is a, c, g, or t
  misc_feature (1563)..(1563): n is a, c, g, or t
  misc_feature (1566)..(1566): n is a, c, g, or t
  misc_feature (1583)..(1583): n is a, c, g, or t
  misc_feature (1638)..(1638): n is a, c, g, or t
  misc_feature (1641)..(1641): n is a, c, g, or t
  misc_feature (1644)..(1644): n is a, c, g, or t
  misc_feature (1647)..(1647): n is a, c, g, or t
  misc_feature (1854)..(1854): n is a, c, g, or t
  misc_feature (1875)..(1875): n is a, c, g, or t
  misc_feature (1962)..(1962): n is a, c, g, or t
  misc_feature (1986)..(1986): n is a, c, g, or t
  misc_feature (2046)..(2046): n is a, c, g, or t
  misc_feature (3237)..(3237): n is a, c, g, or t
  misc_feature (3561)..(3561): n is a, c, g, or t
nnnncnntcnnntnnngnnttgnnttgnnnnncgcnncnngncngncnncnnnncnnngcnncnngncnntnntntttnnnnnantggcntgnnttttnnncncnnnggncnngnccncnncnnnaannngannnnncnancccgnnnngnnnnnntnnnnnttngnnttncnnncnngnnnnnnnnnnngnnngncnncnnnnantncnngnnntnnnnntnnnnngnctncntnnannannnnnggntngnccnnnncnnggnnncntncnnnnncgntnnngnnnngnncnngngnnnnnntnnnnccgcnnnnngnnccngncggnangnnntnncnnnnnncnngggnanngnnncnannnnnncnnnnncnnngntncngnnnnnnntnnnnanggncnnnngnntnngnnnnnnngnngngnnnnggntnnnnnnnnnnnnnnnnnnnantnnnncnnngnancnnnnnnngnntnnnnngnnttnnnnnntngnnnggntnnnnnnnnnnannggncnnnnnnnnngnncnnnnnacntnnngnnnnnngnaaccnncccnntnnntncnnncagncnnntnncnnnngnnnggnnnnnngnngncnnnnncnncnnnantnnnnnnggcangnnnnannnnnnntnnnnnngnngnngnnnaancccaannnntnnnnnnnnancnnnnannnaaannncnancnnnnngngncngcnttnnnnnnnnnnnngnnnnngnccnncnaannnnnnnnnaaanannnananttaagacctcctagacnngcacancctcaatcgcatggaccgcgcccgacagttcttccggaagttgtggcagaccggcgaggccctgcggaaacttccgcgccaactcctcgtagcattcaagtaacggctgctccggattccgcctcaagnaccaagntcgatacgcacgctcgcgcgggtaggtcgtacagatccagtagtcgataggggtcggaaccagtcgcacggtttgggtcgtctccgacttctccccgatgaccagcaacatctccgcgtaacggcccttttgtggcgaggtgaatcgcttgatcgcggcgagtgcnacttcattaaggtggagttggttttccagcacgctcatatctccaggttgttggccgatcagcttcgtattcgcgttcttcacgatgcccgggccgtgcggacgcggctgtatagaggttccaacgaagtcttcgagtgtctgcgaaatgccccagacgctggagttccgtttgcgcgcggtncgaaacagttgaacgacttccggcgccaggacgggcgagtcgagcaatgaccagcactcatccagcacggtaatgctcggctgaccgctcnttccngaagcncgntccgccatngcattcgcgatcancatnctcatngcggtntccaaatgaggatccgatcccagtccctcnacgttgaanaanagccagttgttgtcggtgcggatattggtgtgccgntcgaatanncggctntagatgcccttntcngtccangttcgcaacttgatngcngcnagcttcgcctcatcganggcgcgttgcatcttctcttcgtcctgccattgagcaagttcatcccgcaggtcnganaangtngggaccggattagcgtagcggagccctacccgtttgtaggtccgtccgatcgcctcgctgatgacgttatcgacgagtgtagtatccgagcccggtgcgtcaccgatcatgtgccgggtgaggtttttcagaaatgcgatcttctccttcgacggtgtcttttctccttcgggcaggtcccatggattcagagtttcattgccgtcnagattcacttcgatgactcgnccgcccatgagttccacgagtggccggtatgaatcgccgcgctccaggatggagatctccacgccggtccggcccagcatgagcagnaacaactgagccatgaaggtcttncctcctccgctcttcgccatgatcagcatgttggcatcgcccaagctcggatcgaatggngaaaacggcaccatctggcgcgatggcgtctccagcaagatcccagatgagctcaatccttgccacgggacttcagccggtaacaggtctgctgcatggagcgtcaggcactccagctcgcgtttcgtctcttccgacatccctgggagcgtcccgatgtaaatccttttttgcgcgagagtctccggaataccccgggcgccattcattcgagcgaccgagtggaggacgcgctggcgccggtctgcaagaatacgttcagcctcttccaactcctttgaattgcgtatcgggcgggatgtcctcaagccaacaagcaaactgagctggcacaccttcaacgaactggacacgacatcctggagagtttgaattagctgttcttgtgcaatctgcgcctcgatgttgattttgaagccgccatggatgtctcgctgtgccgcctgcattctcaaaagccgtcgtttgtacgcccgcatgatcttgctttgatccgggatcgtgacctccgcgctgatcaccagcggaaactcctgtccgactagctcgcgcgtgataccggggaatgtggcgtccggcatttccttgacgctgacccaggagtataggagaccgccaacctttaggtggccgtcctgttcgtcttcaatgttgacgttcgcgatttgggcgcgggcgctctcgtaagcgaggccctgcttatacggccgcgtgtcactcgtcagcggattcagtgcccgcttgacttcgagaaacatctcctgctcggtcaaccggcgcggttgcattcccgtggcctcgagtgtggcttgggcgcccgccatcaagctctcaaactccgataggaaatcctcatgttcacgcaccgttcgctggatgcatttgtttgctgagaggctccacttggctcccttcttgcgtgtcttccgccactcgaattccgagctctcatgatggatgtcgggattccagatgaagtaaacgtgcaatcgccgccgcaagtagtgcccttcgttctggcgtgtgttccatagttgtaggcgttcccgatccagcgcctgaagcactgcgttttcgattcgctgttccttgacatagcgctccgtcaggtcgccatggccatccgtcacctcatatcgaacctgcatccgcatcgaccgctcgggcaacgaccttaccaacgcctccagngcttctttggttcgattgcgcgtgtcatccgcgtgaaagaatgtattcagtccgctcgcctcatagcccgctacgaagcacccgttggtgcggatgatgcagccatcgagatagtctcggaccggcagtagttcgcagagcgcgggctggcgcagcgaatcttcccattggcggagcgtttgtggcatttaggatccctctttcaggtattccatgcgctgttctgagtcggactccagtgcgcagtacacgtgcggcttcatgtgaaacatcagccagtcctgcaggtagccacgcggtttcccgtacttgaataggatgagngccggaatactcaacacgggaaccacgtactgcaggaacacgttcatcggaataccaaacatctctcgttgcaagaatcggccgaacatgttcatcacgacggccaggccgaggatgacgaacaaatcctcgaattccaggtaaagaaaagtcaccttcgttgccaggttccttggaaccggtgtcactgtaagtgccatgggcttttcctgtctcgctcgtgaatttgcatcgccgcaattccccttaactaacgcctgccgtgcctttcgtcacgaagaactcgccgagccggagtaggcccgaggccatgaggcacaggatggcccccaggaaatgccgggtatggttgaactggtggtggacctgttgttcaaacagtccgccaaacttcagcgcgcccaccgccacgtgcattccggcatacacgggcagaatg

SEQ ID NO: 1642 - DNA, 4000 bp, Escherichia coli
  misc_feature (1992)..(1992): n is a, c, g, or t
cgagatcgactcaagaaaatagtcgacgacatcaaccgtctcagtgcgtctcaacagcaggaagccggtgtcagtagcgaggagattgatgagttcgacccgcaaattggcgagggcagcgaggagttgacggctgaacaaacacctcgaaagcagtacagtgccgaagaacttctcgccagcccggaaaccgcggcactgtggttgaggagcgtgcagcaaaacggtgggcgcttcctccgcacgaagttcgccatacagctcagcgagcgcggggtcagcgagtaatgggtgcgcgcctagcgaacggttttattagcctattagtcttcttggtggctagcgctggggtaaccgtcaaggcagccaaccctcctgtcttagagcttagtgcagagttagccgctgacacgctggtggtgcctggtcagcgggttcgactattactcaccgtagcaaccccgcggtggtttaccagtggtacccgtatacgcctgcccgaagtgcccgggctggtgctactgcaaaatcaagaattcgctgccaatgcgaccgaacaacggggaacagatagctggacgttacagcgttggtcgatcgatgtattcgcgacgcgacccggtacgctccgcattcccggtgttgatgtcaccgcctcggtgtcgatcaccccaggggtcagtcaaacgctcacccgcaccaccgaaccccttgacctcgacgtgcaaataccctccgaactcgctgagctggagcattggatagccagccccaatgtcaccgtacaagacaccatggtgccggcaggaccgcggcccgtgggcagcgccttgacccgacgagtacgcattgaagctcaggatgttatggctatgatgctgccagccatcgacaccgcatacccccatgagttgcaggcctatgccgctccaccgcttctaaagagtcaagcgtctcgcggcgcgctgagtgcccaacgggtagaaaccaccacactgattgcgaccgaagcggccgacgtgaccctcgatgggattcgcatctactggtggaataccgctacccagcgtctttccacgctcactactgatgatcatgagatcaccattgctggcgcctcaaccactcgacagctgaacatgctacggtccttcgaaatcgcactcaccggcttattactcttgatgggggtactgctgtgtcgagcgctacccctcaagcgatggcggcaacgcctaagccagtggttagccaaaggcggtgagcaactcaagcgtagacgccacgtattggtggctagtccactgcctaaacagctcaaccccggaggtagtcccgccgggccatcagcaaagacccagcgctagaggtagtataatgaggcgcgttgataggaatggatcatgctaggtaaacagacaattagccttattggtttcccaggtagcggcaaaagcaccgtcggcgtactgctggctaaacggcttggcattgagtttgtcgacaccgatctactgattcagacgaaagaaaacgccacgcttgcggacatcatcgcgcgcaacagccatcattatttacgtgccgtcgaggaacacgtgttgaccagcatgtctatcggtcgaagcgtcatttccaccggggggtcggtggtctacagtgacaaaataatgtcacgcttggcacaacaaacccgcatcgtgtatctacaagcccaatatgcaaccgtcgattaccgcatctcactcgctccagatcgaggtattgcctccgctaaacaacaagcactcgccgacatctacgccgagcgtattccactctatgagcgctgggccgagctaacggtcacagtggatggtgctgaccctgaaaccatcgccggacagatcgtcgcggctttggacagttaatacttggcgcggacacgtccatgcattaaaaattcctcccttttggggttatccctccactccctaactcgttgattgcccngttaaaaaatttatttttgtgcgattggcacgaccgttgcatccttcctggcagcggcccacccccgacaggatgtcggtgtagaggaaccagagggacaaggacgtctctcgccaaggaaggcagtatgtggtgggccgctatagtttttttagttatttatagggcgctggaaagcacaaaaaatttgttgctctgttggctaacttgaggccaactcagcagaacagaaagagttttttgttctagcgttttctaaatcatcgggaggtgatttatgagtgggcgtgaccagcagcaaaccactgaagccgacagtgtcgaagattttttcgatacgacggggggtgaattcagtaccggcgacttcgacgacgatctaccggggttagaggcactcaacgaccgtactttgctcgccagtaaacggcgacgcgtcgagcaacggctcgaagcactcaggctgcgcgacgagctcggcgatgataactttaaatttgatgacgatttctgaatcgacgcgccagtccacactggacggcgggtaggtgctctaaacagtgtctgcctaatcattctaactgcgtgtgctgatcgatttctctctgccattcaaagacgtttagttcaataaagacaaaggcgaatagccacagcgctgcatcccaaaaatcgaggaagtcgccttcaaatccccaatagatagccgcggcggcaagtaccaagtagagcatgattttagtggcggttaatccccactgcaggcgctggggcagtccgccctttaactgcacatgcacttcaatttccagtgcaatgacaacgagaatccatgcgcccgcgttgacgacatcgacaagggctaaatcttgagcatcggcaaagatcctcggtgacgcgatgacctgatgcagggcggagatttgcaccgcgtcggcattcaacgcgctgcaattagccgcatttaagggcgtaaaactgtcgaagccgagtaatactgaccaatcttgggtcaccaaatcgcaggcaggttcgggaagactggccgcctgacgaaacacttcccactcgccaatataacccagaaaagccgacacaatcgcagcaccacaaagccagcgcagaccgtgaagtgaccacttagtagcgcctaccagtcgggtatccggcaggattgctgtttccagttcgaacagcaaaagtagcaatacccaggcggcggtatcgagagtggcagagaacaactgaacgagcgaagcgagatcgagctccgctatgccggcgtgcgtggcagaaatgagctcctgctctaaaaacaaataaacattgaaagacagtaataggaaggtgatgtatttaatggccacaaaccatcgatagcctaccgaccgagggtccatagcggctgcaaactcattcatcgatcaccctccccttgattacacttgaagcagcaggtgctctcgctcccaggagctaataacgcggttaaattcttcgaactcgtctagctttaccgctgcataggcccgcataaatagctcgccaatcatttgttgaagttcgggagtgtcatttagctggcgaacaccttcttcaagcgttctggccaccaccacgcctgcttcgtttgcggttcctctgtggggcggggtaggcggtaattgctggcgcatacccaataggccactcgccaatgtcgcggcaatggccagatagggattagcgtcagctccggggaaacggttttctatacgcaggttttccgctgttccattgggcactcgaaatgcagttgtccgattatcaaagccccagctgaggttaatgggcgccgagatatcaggcgctaatcgccggtaagagttgacattgggcgcgtaaaaactgatgagctcaggggtgtagcgctggaggcctcccaagtaatgcatcattgcctcggtgggagtgccgtctgatcggcaaaaaatattctccccggtttctttattgagaatagattgat

SEQ ID NO: 1643 - DNA, 4000 bp, Escherichia coli
  misc_feature (1986)..(1986): n is a, c, g, or t
  misc_feature (2866)..(2866): n is a, c, g, or t
  misc_feature (3201)..(3201): n is a, c, g, or t
  misc_feature (3759)..(3759): n is a, c, g, or t
ggttgctatctggtccccagaaacgaaattcaaaatctggtatgagatcgaggcgcatgcttgcgatgcgatggccgatctgggtgtgatcccgcgcgagaatgccgaggccgtttggaaagccaaagacgttgagtttgatgtggcccgtattgacgagatcgaggctgtcaccaagcacgacgttatcgcgtttttgacgcatctggccgagcatgttggttctgatatggcccgctttgtacatcaaggcatgacgtcttcggatgttttggacacgtgtttcaacgtccaattggtccgcgcgtctgacttgctgctcgctgatatggaccgtttgctggcggcgctgaaaacccgcgcgatggagcataaagacacgccgcgcattggccgctcccacggtattcatgcggaaccgaccactatgggcctgacatttgcccgcttctacgccgagatggaccgcaaccgtgcgcgtctgatcaatgcgcgcgcagagattgcaacgggcgctatttctggcgctgttggcacgtttgcgaacgttgatccacgtgtggaagagcatgtttgcgaaaagctgggcctgacgccagagccgatttcaacccaagtcatcccgcgcgaccgtcatgcgatgttctttgcgactttgggtgtggtggcctctggcatcgaaaatatcgcgactgagatccgccacatgcagcggactgaagtgcttgagggtgctgagtatttcagcgtcggtcaaaagggctcatccgcgatgccgcataagaagaacccgattttgacggagaacctgacaggtctggcgcgtctggtccgtatgtcggtgatccctgcgatggagaacgtcgcactgtggcacgagcgcgatatctcgcattcctctgtcgagcgcacgattggcccagacacgacaatcacgcttgattttgcgctgaaccgtttggcgggtgttgtcgagaaaatgatcatctatccagagaacatgatggcgaatatgcacaagttccgcggcctgatcatgtcgcagcgcgtgctgctggcattgacccaagcgggcgtgagccgtgaggacagctattcttacgtgcagcgtaacgccttgaaagtttgggataataacgccgactttaagacggaattgctcgctgacgcagatgtgcgcaaggcgctgtctgccgaagagatcgaagaaaagttcgaccttgggtatcataccaagcacgttgatacgatctttgcccgcgtgtttggcaaagcctaaaagatcattcggcctgacgcccccgcgtcaggccgatcgatatgcggcttacacgacggatggtcgtgaagcggctgtggttgtggacggtgtgtcgcccgaggaatatgcggcatagtacgttttgcaggcatcgacagcacagcataacgacgaccatcaccctcattgagatatggctctccaatccgttcggcatcaaagccaagctgacgcagcgcacgcatcagtgccaagggtgagagcgacatcaggtttgaggcccccttctcggctgcgacatcgaccaagccttgcacgatcaagccgaggcatttgctacgatccgcgtgggtatcgacgtcattggacatcacaaggcgggtacattcccacatctcgtttgtctcgacgtccgctttcatcacgcttggcgggatgtcgatcagtttgcctttaagcgcatcgcggagcatgtgggtgtggttgccccattttgcagtcgttggcatgacgcgcgcgccgccaatgacctctccatcacgcaagacgaccgaatagtaggcctgcggattgtcgtattgatccatctccaccgaatcatcgtgtgggatatcccatccaagctcatcgacgaaaaaccgcttccgaagtgcgagaaaatcgaaaaatgcggttccatgcaaatgaagttgcgcgaggttaaaagtaatttgttccatgtccgnctcctatgtggcgagttaaaaataccactacaccttatgattgtaacaaattcctgcgacaatcactcgataccgaatcggcgttaagtcttagttaaccattttaggagttgggacgctcagatgaggccgtattggctcgccatggcggcggcttgggagccggtttttgcgccaagtttgagttttgcgttcttaaggcgctgctttaccgcgccttcggtcacgcccagtatatgtgcgatttctttcaggcgtttgccgtcgcggaccatgccgagcgcctctaattcggccatagtgaggttctgtggtggcgccatttcagcatgacggcgggacataaacgcttgaagtaacttaacttctagctcctcgaactcgcggtcattgcgcgcaaacgacccgtaggatcgctggccttccttgttcccgtcaaaaacagaaaccacgacgccgtagcgcaacccaaaagatttggcctgcccgagcacattgcgcggatcatcttgttcaagttcgctccagcgcatgcatcctatggtcgaataggcccagcggatcacgggatcaaaaagcatgaatcggttcagcgtgtaatggtcgatccagccttgcgggagttcgttcacttcttccacgggataagcaaagccgattctcaacgcaaaatagtgccctgcgggcgcaataatgcggagttgctctggatccaaccgttgggtcataaaatagtttttcttaccaagctgtacaaaaacgcatgttgcttcttggtaaatttccttagctttttaatccgtttgttaatttgttagtatttcgttagggtcaactttggcaaccactttggcaaccacaaagaaagaataagtaaatngcaaaccaaatcgcgatccgcgattcacttgcggaccttaagggcattgcaagcgcgggctatgcgttagctttccatattcggtttacgacgccgacctttctttttcagacctatccgaaagactggctcgattattactcccaaaacgggttggtgatgtctgaccctacggtcgcgtggggatttgaaaatgtcggggcaattagttggtctgacctgtcatcggccgattcgaaaggcgtgttaaaaagcgcaggcgaatatgggcttaatttcggaacaacttgcgcattagaggttgaggggagccgcagtattggcagttttgcccntgcggaccgcgagtttaccgcgcaagagcagaaaatcttgagtgaaacgatgggcaacatgcatgcggcaatgacggatttaaagacgctatcgcccgaaacagcggccgcgttgcgtatgatgtcggtgcaattcacacatacttaagtctttgttcacgcttcatttagcaattccatgccagaacatatggcatggaagcaactctctctccccccctttctcggcccaaattgcctgcgatgacccgtaagcgaaaagcggcgatgatcgtgcaacttctcatcggtgatggggggaagctgaagctctctcaattgcccgaagagttgcaggttttgctcgcccatgaagttggtgccattcgattggttgatcgcgaaacggtgcattccgtcgccaatgaatttgcagcgcaacttggcgcgattggcctgtccgcgcccggcggcacagaaagcgcgattgaagcattggcacagcacctgagccctgatctggccaatcggctacgtgcagacctgagcagcgccagaaacggcgacccttggccgatnatcgtcgcactcgatgacactgtgattcttgaaattatgaacacggaaagcgtcgagatttgtgctgtgaccttgtcaaagctacccgtgtcaaaagcggccgcagtgcttgaaaagttaccgggcaatcaggcgcggcgcatcacttatgccatttcagagaccgagaatatcgtgcctgatgcggtgaagcgtatcggcaccgcccttgtgcatgactattgcaccaagaaaaccgtgg

SEQ ID NO: 1644 - DNA, 4000 bp, Escherichia coli
  misc_feature (29)..(29): n is a, c, g, or t
  misc_feature (137)..(137): n is a, c, g, or t
  misc_feature (305)..(305): n is a, c, g, or t
  misc_feature (860)..(860): n is a, c, g, or t
  misc_feature (992)..(992): n is a, c, g, or t
  misc_feature (1125)..(1125): n is a, c, g, or t
  misc_feature (1228)..(1228): n is a, c, g, or t
  misc_feature (1324)..(1324): n is a, c, g, or t
  misc_feature (1351)..(1351): n is a, c, g, or t
  misc_feature (1393)..(1393): n is a, c, g, or t
  misc_feature (2197)..(2197): n is a, c, g, or t
  misc_feature (2212)..(2212): n is a, c, g, or t
  misc_feature (2518)..(2518): n is a, c, g, or t
  misc_feature (2776)..(2776): n is a, c, g, or t
  misc_feature (2882)..(2882): n is a, c, g, or t
  misc_feature (2900)..(2900): n is a, c, g, or t
  misc_feature (3899)..(3899): n is a, c, g, or t
gcgaggaagagatgcttgaggattattcnctttcccaggactatgcagagcatattaagttcatggaaataggttccacactgcgtccctatctctctccagaagtttttgcttcctattgggaggaagaacgtacnaaaatacagacacaagagtatctcaataagcgcctttataatttctctgggaaatacggagaaaacctcttggaggaagtgtatcgctatgccttggtagcagggactatagcgagcaaatatgattttgatattattcatgctcacgattggctgacctatcaggcngggatcttggccaagcgtatcagcggtaagcccttggtagttcatgtacatgctaccgaatacgatagaggaggggagtataaccgcaattctatcgtatatgagatagaaaaaagcggcatgcaccaagcggatcatgtgatcactgtaagtgattggacacgagctatagtgatagagaagtatggagtagctcccgagaaagtgagtactgtacacaatgcagtggatttctccgatgagcagttagaccttcctcctcgtgcgctcaatgaaaagattgttaccttcttagggcgtatcaccttgcagaaagggccagaatactttatagaggctgctgcaaaggtacacaagcgcttacccgatgtacattttgttatggctgggaatggggacaaaatgactccttcggtaaggcgagtggcacagcttaagctcggtgggcattttcattttacaggatttctaagaggaacagatgtacaacgtatgttccgctatagtgatgtatatgtgatgccctcggtatccgaaccctttggtatctccccnctggaggctatgcgaataggcgtgcctacgattatttctaagcaatcaggagtatcggaggtattgcaacatgccatcaaggtcgattattgggatgtcgatgccttggccgacgctatctatggagtactngcctatccaaaactcgcccaatcgctccaaaaggaaggacttacagaggtcaatgctctcaagtgggagggagctgctggtaagttaaaaagcatttatcagacaatgatagcttaaaaaaaagagctacaangttagtataattgagaaaaaaaacgtatatttgttaccaaagaaagacaaccatgaaagcgatatgtttctattttgaagttcatcaccctgaacagcttcgncagtatcatttttttgatataggcaaacaacatgattattttgattattacttaaatcgtacagagatagagcagttggctcgtgagtgttatctncctgccaataatctcttattggagctnattgctcaatacaaaggacgctttagggtagctttttccctntcgggaagtgctattgaactcttagaattgcatgctccagaggtgattcgtagttttgaggctttggccaaaacaggctgtgtggagtttctctgtgagccttatgcacattcgctttcctctctttccaatactaccacagaattcgaaaaggacgttcgccggcacgctcagcgaatagagaaacttttcggtcatgcccctacagccttccgcaatacgtccctaatctattccgatagtataggggaacgtattgctcgcttggggttccataccatactcaccgaaggggctaagcatattttgggctggcgcaatcctaacttcgtgcaccatcaccccaataatgacaaggtaaagatattgctcaaaaatgctaaactcagcgatgatatttctttgcgcttttcctcaagggattgggatgaatatcctttgaccgcagaaaaatatgctcgttggctaaaggccagccttcaggagggggatgtggtaaatcttttcttccgctatcaggctttcggtaagtataatttggcttcttcgggtatttttgatttcttgcgctacttaccacaatatatcttggacgaggagcagtatgctttccttaccccttcgcaggtggcggaaacttttcccgctaaggaagctatctatgtacccaatcctatctcttggacagatgaagagcgcgatattacctcatggctggggaatgaactacaagagaatgctttcgaggaactctttgccctaagtcctaaggtagaaaatattccagatgaagccttgcatcgnacctatagtcgattncagtgtagtaatcactttaactatatgagtactaagataatatctttggaacaacgtcttaagaaagtatctccttatgcatctccttacgatgcttatatcaactatatgaatgttctaagtgatttctctttggagatagacaaggctttggccaaacaggtcaaaaatgaggtaacactacaagaattttagtctttgtttgtcttagaattggaaatagatgaaggcgggagcatcattggagaaagtctgataacagattacagctaccacaaccatcacaaggacttttacccaaagatnactgcggtaataggcctgctctaccttgtccttgagtgactgaggaagccaatgtacagtatagcctaagatcatcaccaagaaggcttctctgaagtaccataatacttgaccactacttgcccagtccatattattccatacttgtccataccattggttgatatgctccatgtcttctccacggaagtagagacgaacaaagacgataaagaggaaggtagagaacaccttccagaagtgtgccaaccaatgggnggaatgctcataagggcttaccttgcgccagagtttgtagaagacaatacccaagccattgatccctccccataggatatatttccaagaggcgccatgccagagncctcctaagagcatggtnagcattaggttgatattggtagtgatatagtgctgaaaacgagtgcttttcattgctaataaggtgccccctaagagcaaaaagcctataatcaatgagaaatagggattacctactccaatgagagctaccacgacaaagaccaaagcaatggccaccgatgcccatgagcctgtacggtttcctcccaaggggatatataggtagtccttaagccatgtggaaagggagatatgccagcgcttccagaagtctcccgtattgatagccttataaggggaattgaagttgcgagggagctcaaagcccatcagcagggcaagccctatagctatatctgtatagcctgcaaaatctccatatacttgtagagagtaacctaccaaggccataaggttcgtaaatcctgaatacatggtgggcatctcaaaaactctatccaaaaactctacagcgataaagttggcaaaaagcattttcttaatcagccccttaaagataaagtaggtacctcggttgaagtcctgtgctgtgatttctgtagggcgaagtatctgagggacaaattcttctgcacggacaataggccctgctactaactgaggaaagaaggtgacatagaaaccaaaatccaaaatagaatccaaggacttgagttttcgcctatagatatccactgtatagctaatggtctggaaagtatagaaggaaatacctacaggaagcacaatctcatctacagagaaagcacccttggaggaaaatccatttccccaataagctaaatagttgaataccttgtgatcggtgtggaaaatggtattgtaggtatcggtaaagaaataagcatacttgaagtaactcagcacagtaaggttcagaacgacactgagggtaacgaagaatttccgcttggattcattctcacttttatctatttgtttgccaaaatagaaatcggttatagtgctgaatatcagtagaagtacgaatagtccnctggttttgtaatagaaaaagcagctaacaaagaacaaaaacaaatttcggataaagatacgcttgtataccagagcgaaacctatatatatgataacaaa

SEQ ID NO: 1645 - DNA, 4000 bp, Escherichia coli
  misc_feature (150)..(150): n is a, c, g, or t
  misc_feature (443)..(443): n is a, c, g, or t
  misc_feature (2054)..(2054): n is a, c, g, or t
  misc_feature (2150)..(2150): n is a, c, g, or t
  misc_feature (2383)..(2383): n is a, c, g, or t
  misc_feature (2680)..(2680): n is a, c, g, or t
  misc_feature (2686)..(2686): n is a, c, g, or t
  misc_feature (3143)..(3143): n is a, c, g, or t
  misc_feature (3448)..(3448): n is a, c, g, or t
  misc_feature (3688)..(3688): n is a, c, g, or t
tcctttagcagccgtgaaatccgggccagagcttttaaatgatcggcggcggcattttccggtgcgaccaggacaaaaaacaggtgcgtcggagccccgtccagcgaagcaaaatcgatcccctcggggctgcgcgcaaaaaccccgacnactcgctcgacaccgttgagtttgccgtgcgggattgccacgccttctccgatcgctgtggtactgattcgttcccgttcgagtagcactttgaggactttgctcttatcgagatggtgcgtcgctcccaaatactcggccatttcctcaagcgcggcatttttatcgcggctcgccagtgcaggaactatggtttctcggctgagaaaatcggtgatcttcacgcgctggactttcttcgctcaagcttgattttttctttttgcttggtgatctggcgctcgactttgtcnatggccagatcaatcgcggcatataaatcatgatgctcttctttggcgagaatcgtcgtgccgcgggtatggagatcgagttcggcgagttggcgctctcttccgtccacggcgagaatcacatgagcctccacgggatggtcgaaatacttgccgatgcgctggatcttttgttccgcatagcgcttcagcgccgcggtgggttgggtatgtcggaacgtgaccgaaactttgatctcgctcatcggtggcgcgcgctcctcaggaggactctatttgcggaagaacggctgtcttcgctttgaagaaggtagaatgcccatcgcctcgcggtattttgccacggtgcgccgcgcaatctcgatcgagtccgtcgatagcgccgcagcgatatgctgatcgctatagggtttgcgcggatcttccgccgagatgatgtggcgaattttttctttgacgctttcgctcgctacgtcctcgccgttgcctcctctgaggccgctctgaaagaagaacttgagctcaaaaagtccttggggagtatggacgtacttattggcggtggctcggctcacggtggactcatgcatgtcgatatcttccgcgacatcgcgcaagaccatgggcctcaaatggctcacgccatgatcgagaaactcttgttgaaatttgaaaatgctctgggtcacccgagacaatgtctgttggcgctgttgaatgctcttgatcaaccagtgggcggcgcgcactttttcctgcaaatattggcgcgcttgttcctcggccgctccttcctgaccggcaagacggcgatacagcgagttgacccgtaaccggggcacgccatcatcgttcaggaaaatcacgtattcgccgccgaccttctcgacaaagacgtccggcaaaacagtccgcacttcatcttgctcgaaacctcgcgacggcttcggctcaagactggcgatgagatgcgccgcttcggcgatttcatcaatcgtcacggccaattctttggccagtttttcataccgtttggattcgagaaagctaagataattggcgacgattttggctgccaaactatcgctcagcttgaggttctcgagctggatcaacaggcattcgcgaagatcgcgcgccgccactccgacaggatcgaaaaactgaatgcgccgcagtacgacttcgacctcttcaggttgagtttctgttgcgctacaaatgtcttcccggctaagcacgagataaccattttcgtcgagattctgaatgacatgcagcccgatagtagactcgcgctcggtgatttttgaaagacgcagttgccaaatgagatggtcttctagggtggttttcttggtcaggctgttttcccaggatggtggtgcgtcgccgtcttccgaagtcgcttccgccgtgagagaaccatggatcgaattggagtgggtatcgaggtattcttgccagtcgagcgtaccgatcttgtccactgcggacaattcgcggttgaccaccaaatccgctgggtcgctcgcggtggccaccggcgcctcggcccttggctgttcagcagtaccctcgggttcttcagtgggtccttcctcaagagcngggttctcctgaagctccttgacgaccatctcttccaattccactcgggacagctgcaacagcttgatggcctgctgcagctgcggagtcattacnagctgctgggtcagcttttgtacctggcgaatctcaagagccatatctaaaacttaaaaccttctcccaaataaaattttcgcgctttttcgctcccggcgattgtttcgggggtaccctcttcgagtattgtgccctcgtttacaatatacgctcgatcgcagattcccaacgtttcacggacattgtgatccgtgataagaatgccgatgccgctatcgatcagccggcgnacaattttctgaatctcagccaccgcaatcggatcgattccggtaaacggctcgtcgagcaggagaaagaagggcgacaatactaatgcgcgagcaatttccaccctgcggcgttcgcctcccgagagcgtatatgccttgtttgctgcgaggtgctcaatacctaacatcttcattaatccgtcggctcgctcctgttgctgatcactgctgagttcgagtgtttgcagcacggctcgaagattatcttctacagagagacgccgaaacactgacgactcctggggcaaataactnatgccngctctggcccgttggtagatcggcgcttcggtcaaatcgtcgtcgttcataaacacccgaccctcatccggctgaaccaaacccaccagcatatgaaaagtggtagttttgccagcgccattgggcccaagcaacccgacaacttcgctgcctctaacctccaaattgatcccgtcaacgaccctccgtccgccgtagcacttcatgacagaaaccgctttcagcagactcatttctgcgcggcatccccttgctcccggttcttcagctcctctggaaaaactgtcgcctgaactctgatcttcccgtcaccctcagttaccgcccggtcctgatccatatagtacaccactttagcaccgctcacttggctatttccctggcgcatcactgggctacccgtcagtgttacagtttttgttttgtcatcgaacacagctttgtcgcccgtggcaanccgattgccttgcgtggcgttcaccttgccctccgcgacgatttgcttcatctgtttcatctcgggatcataataagcggtgagcgtttcactgcgcatggtcatatcggcttgaatggtgaccactcgccccttatatgtaatcgagttttttgtctgatccacttccatccagtctgcagtgatatagatagggtcctttttgttgaattcaaatgtcgagccctttttgccttcgtctttcgtcggcgctgctgcgccggccggcacggtcgaaaagatcaaacacagccctaacagcacgncagctctctgtattcgacccatagtcattatcccccgatcggcgccgctgagctagggctattcttcttcttcgccagtttttcgggctcgatcttggacttcaccgcgcgcacaagacgaacttttttgtcttctatctccacttccatcctcgcgccttctagttcgatcccctctcctacgaccgttgtccgattcggcagaacaatttgatccttggcgggcaggtagttagcctnctctgatttcagtatgtatccctgaaaagtgacctgaacatcgccatgcagttccatccgctccagttccttttcgttgagatagaggagagcctcattaccaatcgtctcagcaacttcgccttttttgtcgtagtaataaaagcgcggctttttgatcaatgcttctttctgttctttgaaatagctggcctcgtcgccgaataattcccagacctttcggccgtcctctatcttggcgcgatggaactctttcagtcgaagcgaagactcgggaaggtagtccaacgctttcattggagttgccttgat

SEQ ID NO: 1646 - DNA, 4000 bp, Escherichia coli
  misc_feature (1396)..(1396): n is a, c, g, or t
  misc_feature (1736)..(1736): n is a, c, g, or t
  misc_feature (2402)..(2402): n is a, c, g, or t
  misc_feature (3697)..(3697): n is a, c, g, or t
  misc_feature (3771)..(3771): n is a, c, g, or t
aaggagccgacctgcttatctacgacgcgcaatatcttccggaggaatacgaagctcacaagcgaggctggggacacagccactggcgcgaagccatcaacgtggtgatggagagcggggcgaaagagttgatcttatttcatcatgacccggatcacgatgatgctttgatcgataaagtagtgcgggaagcacgaaattactatccacgagtgcgcgccgccgctgagggcatggatctgcgggtttaagtagcaagcctctcagccctcaccaactcaccgcggtaagggctgtgccatgctggccagcgcatatcccattacggccatggctgctgcgttctcccgcaactgggcgggaacgaccttgtccagcgtgtcggcggctgtgtggtggtagtagaagtaagtgcgggcatcctgcaaaatgccgaaggccggcactcccgctttcgccagcggagcaatatcggcacccggactatcgttggtgagcttgattacgttggccccgaaacttttcaatatattctgcagcggctgcagcaatggaactgcgatagaagtaattttggcgtcaaatccaagagggtggccagcacccgagtcgctctcgatcgccgccacatgattggaaaattccgcctgctcatccttggcatatgcgtcgtgtccccggccgccgttttcttcgtccatccaagcaatcacgcgcaaggtgcgcttgggacgcaaatgtaattgttgaagaacatgtgcggtctccatcgcgaccgcgaagccagccccatcgtcgatggcgccggttccaaggtcccaggaatccagatgaccggagacgatcacgatctgctcgggatgctccgatcccttcaaatctccgactacgttgtagctagttacatccggtagcaattggggtgtgagtgtgaggtgcatgcgcactctgccttgagcggcgagatgggcaatcagatcagcgtcttccaccgcgaccgcgcctgcgggaataccggccgccgcgctccaaccggtgtgcggtaaacgaaagtccgcgctgccaactgaacgaatcaatgaggcggccgcccccaattgggcggctgctttagcgccattaccacgatagataacagcctcgccgtacgcctccattgctaagccattcgccgccttttccttatcgaatggaacgttgaacagcacgattttgcccgccacctgttcacgtccacgggcattcaattcgtcaaaacttttcactacaactacgtctgtcgtaatcccgcctgccggagtcgatgtacttcctccgagagcagtaagaacgaccttctgcgtggttccgggggcttgtccgggaaactcgaccaggtcggcgttctccgtgccgngcacccagtgaggcgcctttacctgttccaaccgcacctccaggccaagcttgcgcaactcctccgcaacatattcgactgcggcctgagactgtggcgaaccgcttattcttggaccaatgttttcagtaagatgtgcaagttgctggtaggtgtagtcgtcgcgcagagctgcatcccgaattgaagctaactcccgcaatagctgtggcgagaaggcttccgcgaccggcactgcttggggtgccaaatgcggtgcgttatgctccgatggcttaacgtgggaggaaacctgagacatcgcgggacagaatgaaatgagaagttccaatagtagtgnacgaactgttggtgtaagacgaagaacggctttcagagtggacatttgatctgatttttccctaagtaacagttctgtgaccgcgtttactgattgtaccgtgatccccgcagggactccctttagcccgactgcaacaggcgcccggaacgtcagtaatctcagctgagataagtagttaccgcggaactctctttcatacagcgttcactgtattggcgaatggctatggctttgtcatacttccggcgggctaactgtacgttatgagcgacactcccggaattccgctggatttcacgacgacggtcgagatatgcacggcgaacactgccccctacggtgccacgtcggttgctcctccggtgagtttgggagacatcggtcatcatgcgcacgctgtccagttctatgccgatgacagcttcctcctggaggctttaagtcgattcattggtaccgctttgggagccggcgatgccgccctcgtgattgcaaccaaagcgcaccgggatgggcttgaacagcggctaaaggcgcgtggactggagaccatcacggctgtgggacagggccgctatgttgtagtggacgctaatgagactctagcgaagttcatgcgggatggatggcccgatgcggacctgttcgccgacactgtgggcngtgttcttgccgcgaccaagtcagccgctcagtgcgagggtgcccgggtcgccgccttcggtgagatggtcgccgtgttgtgggccgagggtaagcccaatgcggcaatacggctggaacagctctggaatgagctggccaaggaacactcgttctctcttctctgtgcctacccgatgagcgccttctatcgggaggagcacggcgcgcagttattgcaagtctgcgccgagcattccgctgtgattccaggtgagagctacacatccctcattacagaggaagagcgtcttcgcactattgcctacctgcagcagaaagcgctggccttggggaccgaggtactggagcgcaaaagggtggaacaggtgttgcgcgtgagtgaggaggcgcttcgaaaatctcacgccgacctggagtatcgagtcgaacaaagaactcgtgaactattcgaactcacttctcgtttacgggccgaggtcgagcagcgcaccgtagcagaggctcatttgcgtgagttatcggggcgattgctcagtatgcgcgatgaggagcggagaagaatcgctcgtgaattgcacgacagtaccggtcaactgttcgtggctctccaatggaatctcgcacttcttcagcagagtgtgagtaacgtggatccggccttagctgagaaggtttccgagagtgtccgtatcgctgatcaggccatcaatgaagtccggaccatgtcctatctcttgcatcctcccatgctcgatgaagccggattgctgctggcgattcactggtatgtggacggctttgtgaagcgcagcaatatcaaggttgatctggaacttcctgagacgctggagcggctcccccgagatttggaaactactgtcttccgcatcctgcaagaagcactcacaaatgtgcatcgccatgctggaagcagcacagccagggttcaactcaccttagcttcgggtaacttgggactccggattcaggatcaaggtaagggcattcctcggaacaaaatagagggttcgcagaacgttggcaccagaataggtgttggtatccggggaatgcgagaacgggtgcggcagttcggtggcgagcttcagatctcggctggcaacccgggaacctgtgtggaggcgatctttccactgcctcgtgaccaggaacgaggatgcagttactaaagcccttcttccacggtggttaacgcttcagaatgttttttgactggacacagacgttggtgccactccagctctgccgggtgctttggcggcctccggcantggaaaactcgcaataatcacggttccctttccggctgtggattgaatctccacgcggcctcccatctcgtgcnctcgttccctcattccagccagaccaacaccaacgccggtcccggtgagctgaaaattctcgatcaactccgttggcatcccaataccataatctcgcaccgtcagcaccacctcgcgctgcaggcgcttcagttcaatttctgccgtcttactttttgaatgccggtgaatgtttgtcaggctctcctgtagaacgcggaagagcgcaagttcgacaggttggggcaa

SEQ ID NO: 1647 - DNA, 4000 bp, Escherichia coli
  misc_feature (3792)..(3792): n is a, c, g, or t
  misc_feature (3794)..(3796): n is a, c, g, or t
  misc_feature (3857)..(4000): n is a, c, g, or t
aaaattaatttaattaaaaaaattttaatttaaaaaaaatggatgacatttaatctttattaatacttaaacattcttttattttacttttttttaataaaatatatatcaaataataaagaattaaatttgaattaattatgacaaaaattaataggtgaaacaataataaaaaaaatataattaataattttatttaatataaagaaataataatagtaaatacataaatagattaaattttacgttaaaagaaatcaatattatttaaacattattaacatttaaaaataatattctattaatatgagttatttctatatttgtaaatttgtttataaaatataaaaattaataacctttaattaaaaagtcatatccatgacccaaattaatattaaaaaaaaactttttctttttttataatagctgaatgatataaaataaaatatataatttgtatcatatataaaataataaaatgattatagattttatatattagtatatatatttttataatacgttatttaaaattttattatatatattttagacgttttgatgtattatatgttgttaatctatttttaaagtagtattagttgggatacagtaaaaatttattaatgatgtaaatataaggaaaaaaaatgcaaaaaaaaaacatatatcaaatatggtataaaaatatttttattttattggttaaataattgttttataaaattaaatttaaaaattacaaattaaatcagcaagtattttaattactgaagataaaggaaaaaagggaaaaaattgtatcaaatcaaattctactgtaatgttacatcattatggagtatttttttaaattttatcaaaaactttcgttatattaaaaaaaatacattatatttaatcgtggttattattggttttaatgaatttaaactaaatttaattattttgttaagtttcatactttattaattaccgttaatacgataatgatgataataataattaaacgaaattaaaataaataataaatcataataaaaactaaaattaaaaatagcaatattaaaaatattaaataataatattgaaataaataaataaataaataataaatagtaaaataaaatatatatataatttttgtttattgttaattataacttaaaaaactattatacctttttttaaaattttataaatacaaatgataaaggatacttataaaaaattaaaaaaagtttaattagttctatgataaataattaaaaatattattagagtcatacgaaactacgaaactaaacactaacaaatgaatcagtattaaaacatcaaaaaaagaaataaagtaaattaaataaaaatacttttaaaaattttattttgttagcattttaatttaattttaattttaaaatttaaaaaatctctttttatatttttggatacaatttatatattccttatattcttatttataatattgaatactgtataaagtgtatataagaatcgctcactgacttttttattaaattttaaataattataaataattatcattaaaatatttatactatatattatattaaatcaaaatattatcacactttttgatttttaatatcaatatatatatatatacatatatatttcaattattattattattttaatggtataaatttaaaaagaatgatctaaacggtgttaaataaaaaatttaaacttttaaccgcatatacataatataattattttaaccaatgaattttgaattaatataaataataattaataattttattaataaaaaatatatattattatttattatattatttattataagataaattaattggtttaccgaaaattattaaataaatataaatttttattttatctttaaataccatttatgtttaccaattttaattattattaaaaagtgtaaaaaaaaaaaaaaaatattcaactatttcttttcattataatggaaatttaattttaatttcaacatagtataaaaataatttccattattatatgaaattttttatacaaaaagtatcaatttttcaaaattttagaaaaaaaaaaattatatataaatacatgatttctttttttaaaaattcttttttaatttaattatttcaacatatgaatattatttaaatattttaattttatttaatataaaattttttttaaatttgtaaattgtatattaaaattttgtaaataataaataaaatatttttcataaacttatatatatatatatatatatataaattaaaattttataaattattgtgtaaataaacattaatatatatatatataatcaatatgaagacctttataatttttactgtagctgcacttgttgccaaaagttcagctgaatgtatatttagtagatatggttatccatgttgttctggtcaagaagttgtttatgtcgatactgaaggacaattaggtgtcaaagatggtcaatggggtattgaatttggtcactggtgtggtatttcttctaatgataccgccagtactgaaggtcaaaccaatggtccatccccaattgaaaatagtccagctccattaactgacactccaactaccaaaactgttccagatgctccagttactgaaaatggaccagcttcagtcgatgctccagctccaatggatgctccaatgaatgctccaattgatgttccatctccaatggacgctccagctgatattccagctccatctactgatgctccatctactgatgctccatctactgatgctccaactactgatactccaaccactaaaactattccaggtgctccagtaactgataatggtccagctccacttgatgctccagctgatattccagctccaatggacaatggtccagctccacttgatgctccagctgatattccagctccaatggacaatggtccagctccagtaactgatgctccagtaactgatgctccaactactgatgctccaactactgatgctccaactactgatgctccaactactgatgctccaactactgatgctccaactactgatgctccaaatactgatgctccaaatactgatgctccaaatactgatgctccaaatactgatgctccaaatactgatgctccaaatactgatgctccaaatactgatgctccaaatactgatgctccaactactgatgctccaactactgatgctccaactactgatgctccaaatactgatgctccaaatactgatgctccaaccactaaaactattccaggtactccagtaactgataatggtccagctccaattgatgctcctgctgatattccagctccaatggacaatggtccagctccagtaactgatgctccaaccactaaaactattccaggtgctccagtaactgataatgctccaattaccgatactccaaccactaaaacaattactgacgctccggtcactggcgatgctccagttactgacactccaaccactaaaactattggtgatgctaacaccggtggtgacgtggctccaagtggtgaacaatacactcattctggaaatcctttcgctggtcatgaattcttcattaatccatattacactgctgaagtagatcaagctatcgctaatatgtctgattcttcactcatcgctatggctgaaaagatgaaggaatattcaaatgctatttggttagataccattaagaatatgaatgattggttagaaactaantnnncaaatgctatttggttagataccattaagaatatgaatgattggttagaaactaatttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1648 - DNA, 4000 bp, Escherichia coli
  misc_feature (100)..(100): n is a, c, g, or t
  misc_feature (184)..(184): n is a, c, g, or t
  misc_feature (262)..(262): n is a, c, g, or t
  misc_feature (1623)..(1623): n is a, c, g, or t
  misc_feature (1664)..(1664): n is a, c, g, or t
  misc_feature (1986)..(1986): n is a, c, g, or t
  misc_feature (2892)..(2892): n is a, c, g, or t
  misc_feature (3272)..(3272): n is a, c, g, or t
  misc_feature (3495)..(3495): n is a, c, g, or t
aataatggctttacaaaaaggatacaattcatttgtaactataacagaagcagaaagttatttctatgatagacttaaccaatctgcatgggatagtgcnacagatgaaactgttgaacgagctttagtaacagccacaggaattctcgataacttggattggggtggaacggctgtgcctacngccctttatcctttatcgtggcctagagatattacttattgggatacaaaatctggtgggtatgaaactttagaagangatagatcaacaacaagttatggaacttttcctgaagatatcaaaaaagctacctatgagttagcattacacttgattaaaaatatgagcacaatagaagatcaatcatcaggttcgcctagattgaaagatttaaaagttggctctatttctttaacatttgatttaggatctggaattagtaattttaacgaattacctgaccatattcgaaatataattgttaaattcgataatcctgctagttctgcaactaatagaggagttaaagttagtggaggtgcttaatgagttactcaaaactaattaaaaataatgtaaaaatggcatttaatgtcataggtgatattggtgaagatatagtgtttacaaataaaactgtaagtaattataactttactacacaatctgttgatactgctactgatacttcttttactgcgaaagcggtagttgaaaatcaattcagaactaacgatgatacacctagactagaatgtaatttaatgtttgattcagattatttagattctaagaaaattgataattacgacactgttgtatttagaggtaaaacttggaaaataaataaatttgaagataataattatgttattactttaactgttggaagggaatcttaatggctacaatatcacaaatgttgacagctgttgaaggtttgtttgcttccaccgcttggacatctaataacatcaaagcatttcctgcgaattatcaaggggaaattaatgctgaggaatggatacgggtttccgtattaccattttcttcagaattagcttatcaagatgtaatagcaaacggtcaaattgtatgtaatatatttgttccagctggagcaggtatgaaaagagcatatcaaattgctgatttactaaaaacattattagatcaagaagtaatctctggatatctacaaacaactaatagctttataacaaatattggaattgacccaaaagacgctggtttatataatgtagactatacggtcaatttcaaatcaatttaaccaaaaataatataaaggaagaaaacaaaaatggctctaatttcaaatataggtgctggtattttcactaaactaaaatacaaagctgatagtaactatactttaccaacttcagattctgaacatcaaaccttcattggtgctggtggtgattttgaaagttcggtagatgttactaacatcagagaatttccttcatttggtaaacctgctaacattgttaacgtacctagttacggacaatctgtaagtagccaaatacaaggacaatctgatgctccaacactagaatttagtttgaattatgtaccaagtgtacatgatncaattcaagctttagttcaagatggattaacatatgtattncagttggatgtaaaaaattcagctactggtgcaaatgctgcattttacgtaaaaggacaaatagcttcttttgaagtatcgccaaatttgactgattcaaatcaggcaactttgactttaagtacttcaactgactatactggtccgtttgctgacgcataataaaatatatattaggctgggtttaattacccagcttaatcaaattgtataggataaaatcatggataataaaccatttaataaatattatgtattaagaataacttctttacacataaaaaaatctgtagatacatcaataagaaaaacttatgatagnctgcaggacgtagataataaagtcgaggtctttgaaacattagatattttacataaaattagaaaaatgatggaagactttgaatcgaataataaacatttatatataaaacccttagaggaaattaaaaatgaaacacataaagataatagagataacgaagaaagtaccgttcctggatcaggaagtggagataaaacaactaacagttagaggtataaaggatttacaaaaaacattagatgtaaataaaaccgatgatgttgctggtataaaaactttaagtgctatatttaaacaaactgttgtaggtgctaatgaaatggaagattcagattttgaaaactttccgattaaagcattaactgaactatcacaagaaattcttgtatataatggtttagctgcatcagatgataaaggtggtgaattggggaagaagagctagcagaatatgaattggctcatcaattaggtgttacattagatcatatttataatatgtccagcaaagaatatatgggttggattaaatattttgaaacaagaccgtacggttggagagaagatcatagatctgctatattggctcaaacaacttaccaaggtactaaaccacttaaggtaaaagaattatttccatcattaaatatgttttcaaaaagcgaagaacaaaaagatattaaattagaagctggctttaatgaattaaaaaagatagctaaaagaaataatataacttttatggaaaataaaaaatctgaaaaatgatagtatgggcggtgtaaactgcccacttgaaaggtaattatgagagacacgaagaaaataactgcatatgcccttatcaataaaaagagaattaaagaacaagaattatttaaaaaccttaaaaaagaagtgaanactggtgccaatggtacacaaggttacattattaaaaagggtataaacaagggcaagaaaatataatggcaataactactataggcctaagttcggcctctaagaatttagctaaagatattgataaggcaattgaacaagaatttagagcaagagcattaaaagcttttgctgacgtaaaattaacaactccagttgatacaggacaggctagaaatagctggtacattggatacactgaaacatactataatcaaaaaacacctatatcatcaaacattaatatattggttcctaaagataaacctgaaaaaattattgttacaaatggtacaacatatatagagttccttaataatggacattctcagcaagcaccnactaaatttatagaggctgcttttagaagacattttgatacagttagtattgaagtaactaacggataaaggaaacatggctgtaaaattagacataattgctaatgtaaagggacagagcgaaataggtaaattacaatctggtttaaataaactaggtacaaatgctactatagcttcaaaaagattaaaaggtttagaagtagccgctgcaagatcaagntctacttttgctgcacttgggacaactttaaaagttggtgttgctgcatcattagctgctgtaacttttggtattggtaaatttgttaaagacacatttgctgcaggtagacttactgaatcacttcaagtaagatttaaactattattcaattcaacaacagagggtgcaaaagcatttgaggaaatgaataagtttgctagtaaagtacctttctcactagaagcgattgctgcaggatctggtaacctagccgttatatctaaagatgctggagaattatctaaaatattagaagtaactggtaacgttgctgcagctacaggactagattttagacaaactgctgaacaaattcaaagagcatttgctggtggtattgctgccgctgatgtattcagagaaagaggcgttagagcaatgttaggtttcgaagctggtgctaaagtatcaattgaagaaactagaaagaaattttttgaagtatttgctaatggtggtcaat

SEQ ID NO: 1649 - DNA, 4000 bp, Escherichia coli
  misc_feature (1957)..(1957): n is a, c, g, or t
  misc_feature (1969)..(1969): n is a, c, g, or t
  misc_feature (1986)..(1987): n is a, c, g, or t
gtttctaccaaaccattttttgaatagtcatgtcctaattgccaaaacataatacctcccaacttatgtgtaattacataattcgattttgcttttatggattgtttgtcatcaaaagtggcatagcttttttccgttgcattataggcataaggggcttgcgcctcattgtcccaataaaacttatatccagtattttcagaaatacgattctgaaactcattatagccaatgaagtgtttaaatttccccttttgatataaaccattattttgatcaattaccccctcccaagttctggcataaaatgccgcacctataattaatttttttgcaggcacacctaatgataataaatattgaatacaattatcggccgactctttttgcttaatagtactaaataaagcagaatgatgtccagtggtggttgcatatccactaaccaaatcataggtcatcaaattaacataattcacatagggcattatatcgctccaatctactgcatcatttgcaaatttttgaaaacctcccgcagcaaaagtgatggtcatctttttacccaattcctttcgcaaagcttttactagttcagtaaaattgggtttgtcctcaggtgtaaacttatgattcggaaatcctgcaatagcggggtattcccagtctaagtcaattccgtctgcaccaaaatagtccgtcaaggatttaacagattttgcaaaattaatacgtccttctgctgtgctaaatacgtctgaacaaggctcacatcctccccatccacccaaagacaataatacttttaaatccttgttttgatatttcattgataccattttttgaataatggcggtatcttttgcccctcttaattttaattggtcgccttgcaagtgtccaaaacaataaataatatgtgtgaaattgcgtgcatcaaatgaatctagtttttctatgcttcctgcatagtaagcaattacggctttcttttgtgcaatacttgataaagataaaaataataatattagcaagcctataaaaaagaaattctttttcataaaatagtataatttaatgattttatttaataaagatagctaagttattgcttagtttaaaaattatcctattgcttttatcaaaaaatatttaaccatggtagtttacctttttgagtatttgactataaagaaattgaagggtacggattaaaagatgtaattcatctgtcgaaagaaagaaatatagtagtttcaactatccaatcatttattattaattggtttattcttttttttataactttaaaaataaaatcatgaaaaaactgtggattatttgtcttttattgttctcttgttccaatagtgaaaaaattaatgataaaatttacgagggaaatcctgctggatttaaggatattggttttctaaccattaccaacgaaaatactaatgggggttctcaagttgcttatttgagtaaaggacttcaaatgaatggagtggcctactgcttttgtcagtcgagttgtactagagaaggtaaagctgttttttcattgcagtataatgaaggcaccaattttttgagatataaattgggtccatcagatgagtatatttatttcgatacttccaattggtgtattaaatacgaatgatgttatcatatgctttatttggatacaagataagaaaacaagacgtgcttaacgctgatgtaaccaatgctcctgtttcgtcatatcattaagtgctgcccaccccttaccaaattcattttgacttaataagcgcatctataggttgtttgtaaacccagcgtaatgcaattgatgcttatctgaaaataatatatagacagtataggtcataaaaaaggtctcattgctgagacctttgtagcgagaccgggatttgaacccgggacctcagggttatgaagatttttnaagaaaatgaangcgttgatttgtaaggnnttatgttttgacaaaaccgaaatcaaccgatttcagtcgaattcagggggtgttttcctcacgcagtagtgtcagctaggtgttttcttagtttttgcttaagtttaactatcgtattactttttaaacatttattgaaatagtaccacaatgattaaatcatttttaagtgtctttatctcaattgtttgttcaacaattgtgcatgcacaaacaatagatcaacttattaaaaaatttgacaaatcaattgatagccttcataccataaatgaattcaatggaaatattcttcttgtaaaaaatggtataaggctttatgaaaaaagtattgggtttacaaatagcaaagccaatcaaagactaaactcatcatccgcattcaatcttgcatctatttcaaaaacattcacatcttcattgatattgatgtatgtccaagaagggaaattgaaaatagatgatcaagtacattcctatcttcccagtttcccatacaaagacatcactattaggcatttattgaatcatacgcatggaatgattgaatattttgattggattaatgacacacttaaaatcaatgataccattggaaatgatcaattattagtccttttatcaaaatataaacccgctttaaattcagtgccaggtgaaaaattcaactattgtaatacaggatatgctgtattatctaaagtgcttgaaacaatcagcggtgtgccttatgctgcattgttaaaatctaaaatcacaaagccgctgaaacttgaaaacacctacgtgcaaactgtgaagatgtctaattcaccaaaaaacagggtttatggaatgcaatataaagaaggtcgttggaatacatatgaccttaccacactagatgaagttgttggtgacggaaatatttattcgaccgtgtatgatttacaaaaatgggatcaagcactaagggatggcaaagtacttaagcctgaaattttaaatgaagcttatacaccttcagttttgatagaaaaaccaaaaatggtgtatggtcttggctggatcatcaatgagccaggaaaaaaagtttcccattcaggaagttggaacgggtttaaaaataatatggttcgtgatttacaaaatggatacacactaatttcattgagtaatgggacatccggaataacttcttacaaacttcttgatcaatttgaaaaagcactcagcaatttgaaacaataatttaaaagtcatttttaaaatataaacttatatgaaaaaaacaattttatttttaatgctattgccattgctatccttggcccagcaatttacctctgagccagtagaaaatggtgttcgaataaaattcaattctcgtattatgggagaggaaagaacaatctgggtaagggttccagcctcctataatgatgtatcaagttcgaatcaaaactatcctgttgtatatgtattagatggcaagtcggcattttttccagtcactggagttataagttttatgagtgagaaagaccatgtgaattatcaaattcctgaaatgattattgtaggtgtggatactgaaaatagatttcgtgacctaacacctaatgcatcaacaagacaacctaatggagaagaagcaaaaacaccagaacaaaaactgatgatgcaaggtagtgggggtggtgagcaattcttaaaattcttgaaggaagaagtattcacatatattgaaaagcaatacagaacaaacccatttagaatttatattggacattctcttggaggtttaacagccacatatacatttttaaaacatccggaattgttcaatgcaacaatatcaattgaccctagtttatggtgggatggcgcaaaatatgtcaacgaggcgccagcattactaaaaaacttacctgctgataagatgcgcaagtattatgtaagtgtgattgattctataagttacggaggacgtcttcaatttcatacaaatgctatatttaatgttggtaaagc

SEQ ID NO: 1650 - DNA, 4000 bp, Escherichia coli
  misc_feature (396)..(396): n is a, c, g, or t
  misc_feature (499)..(499): n is a, c, g, or t
  misc_feature (505)..(505): n is a, c, g, or t
  misc_feature (571)..(571): n is a, c, g, or t
  misc_feature (697)..(697): n is a, c, g, or t
  misc_feature (976)..(976): n is a, c, g, or t
  misc_feature (988)..(988): n is a, c, g, or t
  misc_feature (991)..(991): n is a, c, g, or t
  misc_feature (996)..(997): n is a, c, g, or t
  misc_feature (1023)..(1023): n is a, c, g, or t
  misc_feature (1025)..(1025): n is a, c, g, or t
  misc_feature (1035)..(1035): n is a, c, g, or t
  misc_feature (1042)..(1042): n is a, c, g, or t
  misc_feature (1162)..(1162): n is a, c, g, or t
  misc_feature (1178)..(1178): n is a, c, g, or t
  misc_feature (1211)..(1211): n is a, c, g, or t
  misc_feature (1241)..(1241): n is a, c, g, or t
  misc_feature (1571)..(1571): n is a, c, g, or t
  misc_feature (1640)..(1640): n is a, c, g, or t
  misc_feature (2704)..(2704): n is a, c, g, or t
  misc_feature (3363)..(3363): n is a, c, g, or t
  misc_feature (3385)..(3385): n is a, c, g, or t
  misc_feature (3388)..(3388): n is a, c, g, or t
  misc_feature (3394)..(3394): n is a, c, g, or t
  misc_feature (3403)..(3403): n is a, c, g, or t
  misc_feature (3414)..(3415): n is a, c, g, or t
  misc_feature (3421)..(3421): n is a, c, g, or t
  misc_feature (3613)..(3613): n is a, c, g, or t
  misc_feature (3732)..(3732): n is a, c, g, or t
ggaaagagtccggaagcaacacaagactgcgttgcttccgaactagaaattgaaatggaattacatagcattccagatagagtgagtccatgcgcctttaggctttttggagatcacaggatcggaatcagatgacatcagaacatcgactgtgcgcctgtaatccgctggaatcaggtaaccaatgccctggggctgattgccaaccaacttgtttatttcacgcatcatccgacgctgatgtttttctgtctgtgcaccggtatcgtcattttccaggacaatatctgctgcttcatcaggatgatctgctgcatacttccaacctttgattgaagctttgaggaagcgggccattttactgacaaaagccttttttctcagatttttttccantacatacaaaccgtcttccaaggtagaaacaccttgatcttcatatttgtagaccactaattctgatggactgaggcctgcatcaacaatttgccagtattcnttgtangtcatggttgaaacacattctgcctgcttctgcagaattggatctacgttaaagccctgcttcaanacagtcactccgtttgaaccgccggtggttggaatacccaatttgctcatccagctcaggaaaggatattcgtttccatagaaccagactcccagcgttttcccacgaaaatcagccggtgatttnatcccgctgtctttgcggcaagtgagcatcattcctgactttttgaaaatttgggcaatgttcaccagagccacacctttttcacgtgatgccaaggcagcaggcatccaatcgatgattacatcggctcctcctcctgctataacctgaggcggcgcaatatccggtccacccggcttgatggtcacatccagcccttcggcttgatagtagcccttgtcctgggctacaaagtaacctccaaactgagcctgtgtaacccacttcaactgaatggtnactttatctgcngcntgtgnngaaaatgccaacccgactgtcagcancnccatcactanttttttnattatactcataattctctccattcgagattaaaattaagtcagctttttgtttgcaacaagcaagttagctgaccctgaaagatgggtgccatcctgtaaactgccgttccaaaaaagncagcaaggcatagaanaacgacccggacaatgctgccaccgcaatggangcccatacgacgtcaacattcattcgaccnatttcggtggaaatacgaaaccccattccgacaatcggtgtaccgaagaactccgccactatggcaccaataagcgccaaagtagagttgatcttcaatgcgttaaaaataaaaggcagtgcgttcggaagacgtaccttaagaagcatctgccagtagtctgctgcataagagtgcattaagtcaagctccattcgatccgtggactttaatcctgtaagagtattcaccagcatcgggaaaaaggtcatcataaccacaaccgctgccttggactgccagtcaaacccaaaccacataaccatgattggagctaccccaacgatgggnagagcactcgccagattccccagtggaagcaggccccgctgtaaaaaaggaactttatcaaccaaaacngcaaccacaattccggagacacaacccatgaaaaaaccggctagcactgctttcaaaaatgtttgctgaaaatcagcccagagcatttccagtgagtttgcaaaagcaactccgatcaaggacggtgccggcagcaaaacctgtggtacctcgaaacctatcgtcaacatttcccacaaataaagcagcatccctccaaataataatggaacaagtaaattgatgacaattccagtttttttattgagttgggtttccaccctcgaccagaatcccattacctcccacatcagacccgccagcgtcacaacatacagccaaatgccccaggaagttgtacccgattctgcagaatgtacactgtttaaggttgccatacatccggatgcaaccacgagagttatcacaattttacccggcatcagcacggttacccctttgcgaaaaagagctgctgcagctccgatcagtggcatcagggcaaacagaaaagtgttaactccaaacgacatccagtccctggaaaacagaaactggattggaaaacagattataaataaccagtagaaaattccggaaattttcatgcctgtacacccattcttttttgaaccctgttttccatgactgtcatcagataaacaaatgatccagcaataatcgaggcgacaaacagtgcactccaaatttgtactgtctgtccataatatgaacctgtcaataaacgggcacctaaaccggcccttgctccagccggtaattctcccactatcgctcctaccaaactgatggctatagaaaccttgaaacttgcaaacagaaaaggagtcgaggtgggccagcgtaatttataaaatgtttgagatttagatgcattgtaagttttcatcaaatccagatgcattggatccggtgagcgcagacccttgaccataccgattgcaattgggaaaaaacagaggtatgcagaaatgattgctttaggtaaaagacctgttacaccaatggctcccaagacaactataaccatcggtgcaattgccaaaatcggtattgtctgtgangcaattatccagggtaaaacacttttgttgagtgttgatacgtgcacaattcctactgccagcaaaatacctaaaactgcacccattgcaaaaccaaccagggttgacgaaattgtcacccatccatgataaaccaggctgcgcttggaacttattttgtaaccaaaaatcgacttcttcatgtcgagcataatctggtgcggtgccggcataaccggacgtttcatcgcccaggaatcttcaacaagtttggaaaaattccactcaattttttttcgatcatatttatctatcaaaacatctgaattgagataaactgctgctccataccaaatgacagtggtgaaggcaagcacggctgcaatcgaaaaaaaagatgaggtacgaagccaattcataacatctggtcaatcataactatgacctgcccgcaaaccttcccggatacggtgcgacagtgcaaggaattccggagtgtcccgcatatctaaagttcgtttttctggaagggtgctttcgattatgtcgatgatttttccgggacgcggtgacataaccacaatttttgttgaaaggtatgctgcttcaggaatggagtgagtaacaaagactactgttttctgggtttcttcccaaagtcggtgaaaatgttcgtttanttggtcacggacaatttcatcnagngcaccnaacggttcntccatcaacannaaatcnggattaaatgtaagggcacgggcgatagaaacgcgttgctgcatgcctccggaaagctgccaggggaactttttttcaaaaccggaaagatcgaccatttccaaaacttctttggaacgtcgggcctgttccgttttgtcgatgcccattatttccaaaggcagtttaaggttgccttcaacagtgcgccangggtaaagagcaggtgcctgaaaaacataaccgtatgcacgctgcaagcgggcctcttccggagtcatctcattcacctggatgtcgcctccggtaggtttttccaggtctgcaatcanacgtaacagcgtcgtttttccacaaccggaaggcccaatcagtgaaataaaatcgcctttattaatttccaaatcaatttcagaaagagcgtggaccgggccgtctgaagtctggaaaaccaagtcaactttacgagcctctacaacccggacactttctttcattacgatgaacgatccacggaagttggagcagtagcagagctccgtttttcaactgcagcataatatggggcaaaacatggacgatccacataacggcctacac

SEQ ID NO: 1651 - DNA, 4000 bp, Escherichia coli
  misc_feature (57)..(57): n is a, c, g, or t
  misc_feature (94)..(94): n is a, c, g, or t
  misc_feature (2266)..(2266): n is a, c, g, or t
  misc_feature (2460)..(2460): n is a, c, g, or t
  misc_feature (3843)..(3843): n is a, c, g, or t
catgactgaactctggcgcccctccccggcccgcatcgcggacgcgaacctcacccncttcatgcgctgcctgaaggcgcgccgcggcacgctnctgcgcgactacgctgagctgtacgcgtggtcgctggcgcagccgcagcagttctgggccgaactcgcgcactttgcagacgtacgggccgactggggcgaggggccggtgctggagaatccgcagcagatgcccggggcacgcttcttccctaacgcgcgccttaacttcgcggccaacctgctcaagttcgacgacgagcagccggcgctggtgtttcgcaacgagcgcggcgcgcgtcgcgtcctgtcataccgtgaactgcgcctgcaagtggcgcgcatcgccgacgggctacgcgccgcaggggtgacggatggggatcgggtcgcggccttcatgccgaatctgcccgagaccgccgtcgcgatgctggccacggccagcctgggggcaatctggtcctcctgctccccggattttggtgtccatggggtactcgaccgtttcggtcagatcgccccgaaggtgctctttaccgccgacggttacttctatggcggcaagaagctcgactcactggaacccatggccgccgtgctcgccgagcttcccggcgtcagccgcgtcgtcgtggtgccctacgtcgaggcggcgccgcaacttgagcggctcggggcggcaagcgagcgcgcctgtctgtgggaagactggggcgtgcgtggccggccgctgtccttcgcgcagctgccgttcaaccatccgctctacatcttgtattcctccggcaccaccggggtgccgaagtgcatcgtgcacggggccggcggcaccctgctgcagcatcagaaagagcacctgctgcacgtggacctgaagcgcagcgatcggctgttctacttcaccacgtgcggctggatgatgtggaactggctcatgagcggtcttgcgaccggcgcgacgctggtgctctacgacggcagcccctttcagcccgaggcgggcgcgctgtgggaaatggcaacccaggagcgcatcaccgtcttcggcaccagcgcgaagtatctctcggcgctggagaagcgcgattacgcgccgggcagcgttgcggatctgtcggccctgcgcacggtgctgtccaccggctccccccttctgcccgagggtttcgactacgtctaccgctcggtgaaggccgacgtccagctcgcttcgatttccggcggcaccgacatcgtctcctgcttcgccctcggctgcccgacgcggcccgtctaccgcggcgagatccagtgccgcgggctgggcatgagcgtcgatattttcgatgacgccggggaagcgctgcgcgggcagcgcggcgagctggtctgcacggcaccctttccctcgatgccggtcggattctggaacgatcctgacggcgctaagtaccgcgccgcttatttcgagcgctttccgggcgtctggcaccacggggactacgccgcgatcaccgagcatgacggcgtcgtgatctacggccgctcggatgcggttctgaatccgggcggggtgcgcatcggcaccgcggaaatctacgcggcggtggagagcctgccgcaggtggccgaagcgctcgccgtcggtcaggaatggcagggtgatgtgcgcgtggtgctgttcgtgcgcctgcagccgggcgtcgaactcgatgaggcgctgaagcgcaccatccgcgaaaccatccgcactcagaccacggcgcggcacgtgcccgcgcgcgtgatcgccgtccccgacatcccccgcacgctgtccgggaaactcaccgaactggcggtgcgcaacgtcatccatggactgccggtcaaaaacctcgatgccctcgccaaccccgctgcgctcgagcactttcgcgatctgcctgagctgaagatctagcgcccgtgaatgactcagccccgggtgccacccgcgccgcggacgaagacctgctgcagcgttattaccgcgaggtccgggagcggcatttcgtagccgacccggcgcaaatcgccgccgtcaaccgcctcatggatcttaaggcgcgcctgctcgcccgtgagcgcccggcggggctcgcgggtcgctggctgcgggccctgcggccggcccgggcgctcccaccggtgcgcggactgtatctgtggggcggcgtcgggcgcggcaagacctggctcatggatcacttctacgccgacctgcccttcntcgagcgacggcgctgccactttcaccgcttcatgcatgacgtgcacgcacaactcgccacgctcaaggggcggcgcagcccgctgcagcacgtcgcggctggcatcgcccgcgacacgcgggtgctgtgcttcgatgagctgttcgtcaccgacatcgccgacgccatgatcctcggtggcctgttcgcgggnctgttccaggcgggcgtgacgctggtgacgacctcgaacgtcgcgccgcaggatctttacaaggacgggctgcagcgcgagcgcttcctgccggcgatcaccttgctcggggagcatctggaggtgctgcaggtcgccgctgccaccgactatcgcctgcgccagctcacccaggcgggcacctacctcatggcgcaggccgcggacagcggtgcgcgtctggaggcactgttccgcgagctcagcgacgcgggcacacaggccggcggcaccatccagattgaaggccgtccgatccccgtggtgcgcgcagctcacggcgcggtgtggttcgatttccgcgcgctgtgcgccggcccccgcagcccggaggactacattgagatcgcgcgcgagtaccagtcggtaatcgtctccgacgtgccggtcttcgacgcggcgctggaggatgaggcgcggcgcttcattgccttggtggatgagctctacgaccgcaacgtgaatctcgtagtctccgcggcggcggctccggcccagctctacgccggcagccggctgcacgcgctcttcgaacgcaccgccagccgcctcgtcgagatgcagagcgcggcctacctggcacgcgaacaccgtgcctaaggtgcgtaaggtgggccccctcagatcaccccgcgccggatttgatcctgctcgatcgattcgaacagggcgcggaagttgccctcgccgaagccctcattgcccttgcgctggatgatctcgaagaagatcgggccgatgacgttctgcgtgaagatctgcagcaacacgccctcgcccttctcaggattgccgtcgatgagaatgcgccgctggcgcagctcctcgagcgcttcgtggtggcccgggacgcgcgccgccacgccctcgtagtaggtgtcgggggagtcctggaacgcgaccccctgcccgcgcagcacgtccacggtgcggtagatgtctgcgctcgcgagcgcgatgtgctggatgccctcgccgtgatactcgcgcaggtattcctcgatctgactcttgtcgtcctgggactcgttgatgggaatgcggatcttgccgcaggggctcgtcatcgcgcgcgaaaacagcccggtgtgcttgccttcgatgtcgaagtagcggatttcacggaagttgaacagcttctcgtagaatcccgcccacacgtccatgcgtccgcgcccgacattgtgcgtcaggtgatcgatgagcgtgagcccggcgagcgcggcagactgcgtgccgccctccaccggacggaagtcaacgtcgtagatggatcggtccccgtacagatcgacgagatagatgagggagccgccgatgccttcgatgcaggggatgttcagntccatgggacccgcgctgctcggaccgggcttggcgccgagtgcgagtgcgcggctgtaggcacgcgcggagtcgtggacccggaatgccatggcgcaggccgacggaccgtgtgcgcgcgcgaaggcctgtgcaaaggattgcggttccgcgttga

SEQ ID NO: 1652 - DNA, 4000 bp, Escherichia coli
  misc_feature (2001)..(2001): n is a, c, g, or t
  misc_feature (2003)..(2003): n is a, c, g, or t
ctgaataaccctgagtttgatcgttacgacctatcgtcgctgcgctgttgcaccgtgggtggacagaccatgccgaagcctaaaatggaggaagtggaagcgcgctttggctgcccgttgatagagctgtgggggatgaccgagttagggggattaggcagtacttttgcctctaacgggccggtgaaacacggttctattggtgtggcgttgccttacacagaagcaaggatcgctcataccgaagatgctaaccaaacactaccgctgggcgaagtgggtgagctgatgatcaagggcgggattgtcatgcaaggctattacggtaatgagcaggcaacccgcgagacgattgagcccgacggttggttacataccggggacgtggcttctatggacgaagacggctgcatttttatcgttgatcgtaaaaaagacatgattctgacggccggctacaacgtgtatcccgctgagatcgagcgagtggttgcggggcatccagacgttgcgctggtggcagtggggagtatcccggacctcgaaaaaggggaattggccaaggcctatatcgtccctaaaacgggaacccagcccgatacagagaatgtcattgcctactgtcgcgagcatttagctgcctacaaagtacctcgtgcagtgcagtttgttgatgatttgccgaaaaccagcaccggcaaagtgatgcgccgcgagctgaaaaaattagataagtagcatcattgggagaaccagctatgaaaattgacagtgattttgtcatgacgattaatggtcaattcgtcacgacagagcaaactcagcctgtttacaaccctgctactcggtcggtctttgctcaggtgcctgatgcgtctcaaaaacagctcgatgagaccgttcagtcggcgcatattgcgctcaaaacatggggcacaaccgccgctaacgacagacaggcggcactcgagacttacgccgatttactggaagcgcatgccgatgcttttatgtcgttgttgacccgtgaacagggaaagcctcgagcgggggcagagtgggaagtactgggttccgttgcctggctgcgtgcagtggcatcacaaaggctgcccgacgaggtggttgaggacaccgatgatcgccgcgtggtgacgcggtttaccccagtcggcgtggtcggggcgatcgtgccgtggaattttccaatcttgctggcgatatggaagattgcaccggcattaatgtcgggcagtacgatgattctgaaaccctctccctacacaccgctgtgtaacttaaaattggtagaactggcacaacaggcctttccgcccggggtcatcagtgcgttgagcggcggtgatgacctgggtgtgtggatgacgacacatcctgatatcaataagattgccttcacagggtcgactgagacgggtcgacacgttatgaagtcggcctcggcaacgattaagcgggtcacgcttgagttaggggggaatgatcccgccatcgtgttgcccgatgtggatgctaaggccttggcaccgcaattattttgggcagcgtttcagaataatgcgcagttttgcaattcgaccaagcggctttacattcatgaggatgtgtacgacgaggtgcgggatgcgctggccgattttattacgcatcacgtcaaagtaggtgatggcgccgaagcggataccgatctcggtccgatccaaaactccatgcaatacggcaaagttcaggactactttgccgactgtcatgttaacggctataccttcgcactgggcggcgagattgatgagaaggcggcaggatggtttgtccccgtatcactggttgataaccccccagatgattcgcgcattgttcgtgaggagccgtttggtcccatcctcccgttgatgaagtggtctgacgaggccgatgtgattgctcgagctaacgatacgatttacggattgggagcctcagtctggggtaaagacctcncngcgatagagcgcattggtaagcagttagaggcggggacggtgtggctcaacgaggttcaccagtactcgccgtttcaggcctttggtgggcataaacaatccggactgggttgtgaaaactcattgcacgggctgatggaatataccaactggcaaacgatcacgatgaacaaagtcgcataggggggaagctcaggatgccccgagacggttcacgttgacactgtctatcacgctgggacgcgcctgttgcgatcgtaacgcttttgaggcgggatgccccgccgaatggggaggcgagcgaatcttcatcctgctgcctgcctgatcgaagcggttgttttcgtcggttatccggcatactgggggcagcagaagtgccgatgcgatgtgttccgacataaaggagcgtaggtggattacggagcagtcagtctcatacccacagccttggtattgctgttggctatttggagtcacagaacactggaatcggtgatctgcggtgccatcttggcgtttctaattatggatggctggcaatttgctgatcgtctggccgtcgtgaccacccaggtcctggccgacgaatcaaccgcctgggtactgctggtctgtggtctctatggcagcttcattgcgttgctggtgaagggtggtggcgcctatgcgtttggagaatggctggcccccaaactgcagggtaagcgcagcagcctgttggcgacctgggtactcggactggccatatttcttgacgactatctcaactcgttgaccgtgggcgccacaatgaaatcggtcactgatcgatttaaaacctcgcgagaaatgctggcgtatgtggtggattccacagctgcccccatgtgccttttgattcccatctccagttggggggtctactttgcagggttacttgagaaaaatggggtggccgagtcggggcagggtatcgcgctgtttgtggaatccattccttatatgttttatcccttgttggcgatcgtcgtggtcccactggtgatagtgggtgccataccactcatgggtgcaatgcggacggctgaagcgcgagcagaagagctgggtgatctgggtgtggtcgaagaccctttgttagcggttgaagcctcggaaaccgcaacgatgagtgtgttctttttgccaataggcgccttactgttctttacgatcatgccttcggtcgatttgctgcggggggtcatcctcggcattatcgttacgctgctgcagtacagtgtgctgcgcgttatgccaatgacgacattgcttgatacctgtgtagacggcgtaaaatcgatgcttccggtcttggcgatgttgctcgcgctatttgtttttgtggaagccaaccaggctatcggcttgaccgactatgtcattgcggggatcgaaccgtatctctcggcagcattgcttccggcactgatgtttatcgtgatatcgctcgtcgcctgcacgaccgggtcaaactggggggttatcgccattgcgatgcccgtggcttttccgttggcagaggccttcgatgtacctatgccgttgatgattggcgcgctgctgtcagcgagttgcctaggcagccatgcctgtttttactcagactccaccatcttgagtgcacagggagcgggctgtaagacccatgaccacgccatcacgcagttaccgtatgcgctcataggcgcagcgggtgcggcgactttatttatcgttgcgggtcttttagcttcctagtttgcacagggtgctgccctggcggtaaaaggtgcagcatgcctcatgtctggtcgcggtaagctgccgctacggcgtattttttgtgtccatgagcagttgttttgcggctttgtaatcggccttgccgttcggcgcgcgaggcacggcgggcacgatgaggagctctttgggcaccttgtaactggctagcagaccgcgcgtggcggttaagacatcgtcagcactaactgcgc

SEQ ID NO: 1653 - DNA, 4000 bp, Escherichia coli
  misc_feature (1949)..(1949): n is a, c, g, or t
aattccactttcagcacttatgcctgctccagaaaatacaacaattgttttcatttttcatagatataaaaaagccccgacattagcaatgccggggctttaatcttttacctctgaaagaagtgaattggtattatttgattacaacattttcagtgtatactcctgattctgttgaaattgtcaccaagtacgatcctgcagacaattccccaactgggaaagtaacattttgagatccagactcagtagccaaaactcttccttgaagatcaaggatagctacattataagtagacgcttcggcgttgaaactaatattcaatacgtcagacgctggattcgggaatattgaaacattttcaatgttgatgtttcctactcctgaagatgcatctgttctcatcgctgcgccacgctcaatgtctgaccatccactaccagcgtcccagttaaagataacattcccaaatgattttacttcaatcccaaatccaccttgaggatttgttcctgttccgtattgttgaccatcaccgtagctgtcgattaatttaacagaatagcaatccacaccattcggcaaggtatgagctgatgttattgttgtttgagcgtctgggccacctgcaccaaattgatcgtcagttccaggggtgtacggacctcctgaagcaacaacagttccagcagaagaaatgatttcccatgaagtttctccagggtagttgtctgtgaagaagtcaacgttaatactgtatcctgtagatgtggctgcaactacttcaaatgttcctgtacctgagttgtccgctgtgttgtccgcaacaccatttggattggacactgatacattaatcgtatttgttcccactataggattgaatgtgattggatttaaagtaatttgcgacgatgcacctggagcgattgaaccagtccagttcatcacctcagatgttccaccattgatatcgtaagtaattgttgccgatgtcattgtgtttgatccccaattggttattgtagtgcttggagaaattgtttgtgccgctgttccatcacaagattcaatatcagaagttgctgctgagctaaagattacctcatccgttgcagtgaatccagtcaattgtggattgattacttctcctgttaagatgtctccgtttgcttgatttccatcattgatgaacgcagcaatctcaaggtcagccaattcaagggcaacaccattgatgtctgtcggaagtgtttgcgtgtaggacataattgccgttgcaccagttgttgttgtgttgattgcatctccccatactggagtaataaaatctctaaacatgtgagaatggttgtaatttccattcggtaaaacagctgttgggttgtacgttgctccaccagtctgtggcccttcaacgttgttttgaagaagtgctacatacatgtaatttgttgaatttggagcatttgctgtgtagtagtattcaacgtcaacatttaagacacgcgtaacgatgtctactgttgcagagatgtgcatattcacctcagatgcctcagagataatttgaggtactttgtcagcgtcgttcgaacctgctggatgataggtttgcgaaccaccaatggttcttctgttaagcgtcgatgctggatagcctgatattgagaatagcgaggcgttatcgtctccatctgtcgtacggaagtctggatctccgccacttggtgctgcatatccaccggtatggatatttaatgcaacaacatctccagggtttgtagcgatagcttgatcaacagcaatgtgaccagttgggcaatagacacaataaattccagtccattcctcaataacggcatttctgttttctggtgttgtgcttacgttcacttgggtgtttccaatcatcggaaaagccaaagctccggcaaacaataatttngtaaagtttttcatgattttttgagtatgttagtttttagcctcgaaatttcttgttttttttttgaataaacaacaataacatcaaattcttttaatattgagatcatttttagtatttcatattgtgacagattttgtttagttggttgtttctactctttttggaacacgaaattatttcattcatttcctcacgctttttcgtacatttgttcgcttcaaaagaccctaaatggcgaaaattagaaaacaagatgcattggattatcattcttctgggaaaccaggtaagattgaggtagtccctacaaaaccatattcatctcaaagggatttgtccttggcatattctccaggagtggcagagccttgtctgagaatagcagagcacaaagaagacgtttacagatatacaagcaaaggaaatctggtagctgtcatttctaatggaacagcagtccttggattgggtgatattggtcccgaagcttccaaaccagtgatggaggggaaaggtttactattcaaaatctttgcagatattgatgtttttgacattgaattggatgcaacagatccagagttatttattcaaacagtgaaagcgatggccccaacatttggggggattaatcttgaagacataaaagcacctgaagcattcgaaatcgagcagcgattaaaagaggagcttgacataccaatcatgcatgatgatcagcatgggactgcaattatttcttctgcagccctgatcaatgcgcttgaattggcaaaaaagaaaattgagaaagttaaaattgtagtttcaggagcaggagcttcggcactttcttgtgcgaagttgtatcacatgctgggagcgaaggtggaaaatattttcatgtttgattccaaaggattgattcattcaggaagaacggaccttgacgcgaataagaagttttttgccaagcacaagcaatctgttccttttgaggacgcatttagaaaagcagatgtatttcttgggctctcaaaaggaggaattgtatcgaaagaaatgattcaaagaatggcaaaggatgcaattgtatttgctcttgccaacccggagcctgagatttcttacaaagacgcaatgtcggtgcgagaagacatcattatggcaacaggacgttctgatcatccaaaccaggtgaataatgttcttggctttccatttattttccgtggagcactcgatgttcgtgccaaatgtatcaatgaagaaatgaagcttgcagcagttaaggccatagcttccctggcaaaggaaacaattcctgaggaggtcattgaagcatatggagagaaaaacatttcttttgggcgtgatcaaattattccgaaaccattggacccaagactgatctattatgtggcccctgcagtggcaaaagcagcaatggattcaggtgtcgctcagcatccaattgaagactgggagtcctatgaaatggaacttaaaaaccgtcttgggttagacaataaattgatccgaaatattacagaaaaagcacagcgatctccgaaacgtgttgtcttcgctgaagcagacaatataaagattttaaaagcggctcaaactgcatgggaagaaggtgtggcagagcccatccttttagggaaagaaaaacgaattcaggaactgattgaagaatatgcgattgagattccaaatgtagaaattatcgatccgaaggcagatactgagaaagaaagacgtgaagccttcgggaatgccttttttgataaaagaatgcgcaaaggaatcacccattttgaagcaattcaaatcatgcgagaacgaaaccactttggctcaatgatggtagagttgggtgatgcggatgctatgatatcagggattacgcgtaactacagagatgttgtacgtcctgcaattcaaactgtcgggttacagaaggacatgaacagagtagctggtatgtatattttgaatacgaaacgcggcccgttattccttgcagatacaaccattaatttaaatccttcggcagaagatat

SEQ ID NO: 1654 - DNA, 4000 bp, Escherichia coli
  misc_feature (277)..(277): n is a, c, g, or t
  misc_feature (544)..(544): n is a, c, g, or t
  misc_feature (1210)..(1210): n is a, c, g, or t
  misc_feature (1281)..(1281): n is a, c, g, or t
  misc_feature (1982)..(1982): n is a, c, g, or t
  misc_feature (2038)..(2038): n is a, c, g, or t
  misc_feature (2187)..(2187): n is a, c, g, or t
  misc_feature (2432)..(2432): n is a, c, g, or t
  misc_feature (2917)..(2917): n is a, c, g, or t
  misc_feature (3329)..(3329): n is a, c, g, or t
  misc_feature (3413)..(3413): n is a, c, g, or t
  misc_feature (3511)..(3511): n is a, c, g, or t
  misc_feature (3662)..(3662): n is a, c, g, or t
  misc_feature (3979)..(3979): n is a, c, g, or t
ggtcgtcaggcccgcgagcgcggagatgccacgcagcgtgcccgtcttggcccgcggcaccccggccacggccgcggtgtcaggctggttgaagcgggtcgccaaggtgccggtcaggccggaggtcgggagctcggcgaggactcgccgcatccccgggtgtttccctccgagtccggtggccagcacgtgatcgacggtcgtgagcgggacgagttgaccaggtcccaggccgctggcgtcgtggatcgtcgtgcccgaggtgtcgattccggcnttggccagccccgcgagcacgaagggcccggtgttgccgtcggcggggacggtgccgccggaggcgacgatcgcctggcgggagaggttctcgaggatggcgttgtcactctcgtccatgccgtgacccagcacctcggcgatgggtgcggaggtgaccgagcccaggaccttggcatccttggccggagccggaccgggcggcaaagcggtggcctcgcggccgtgggccaccagcgcggccacgaatgcctcgaggctgtcgtcnaccgactcctgccggggcaccaggccgtgctgcgggcgattgtcggccagcccgatcatcgtgacccggcgcgtgtaaccggcgctcacatcggcggggttccacgaggacgggatcggtgggcccgcggcatacgaggcgtcgagacggacggtgagcggaccagcgggtgcggccgcagcgacctgagcggcgaggtcaccgagaccggcacggcccacgacggcggtcgggtccccgggcccggtcgccagcagggtgtcacccccggccacgagcacgacctcgccaggagcgcccgcaacaacggtggtcttcatcgtggactcggcgtcgaggacatcggtgatggccagcgccgaaaggatcttctgggtggaggcgatggtccgtgggcgctcggcgtcggtggacaccaggacctcgcccgacgtgatgtcccggaccacggctcccgcgccgccacccagggacgggtcggcgagcagagcgccgatggcggcagcggtcccttctctggtgggcgcggggccgagtgcggcgctgggctcgggcgaggtcgtcggcagtggggtgagcccggtcgggaccggctcggggagcgtgaggatgccggggacgaggtcattggcgtcggccacggcatacccgccaccggcgagcagngcgagggcgatgagacctccgacgaccttcttggcgtgtcccacggcacctccccacgacatcgcacccgncatgcgcgacacttggccagcagcctaggtgactcaaggaaagaggcagacgtggagttcgacgtcacgatcgagatccccaagggagctcgcaacaagtacgaagtcgatcatgagaccgggcggatccggctggaccggatgctcttcacgtcgatggcctacccgagcgactacggctatgtcgaggacagcctcggcgaggacggcgacccgctcgacgccctcgtgctcctcgacgagccgacctggccgggatgcctggtgcgtgcacgcccgatcggcatgttccacatgcgtgacgaggccggcggcgacgacaagatcctctgcatccccgccggggacccacgcaagagccacatcaaggaactcgaggacatcaacgagttcgatcggctcgagatccagcacttcttcgagacctacaaggacctcgagccgggcaagtccgtcgagggcgcccactggaccggtcgcgtcgaggccgaggagaccgtgcggcaggccgtgcaacgagccaaggacgcagggctgtcgacggcgcgctggcggaccccggagatgggcaacaaggccattgccgagttccagagcaaggtccggcacagcgaggccgagttgcaggcggcgatccagaaggccgtgcgcgagctggccacgaaggacaatccgctcagcgacgactgagaggccttctncgacaacgacaaaggtgccgcgccccttccccggggcacggcacctttgtcgttgncgtcggctcagtagcgtgcgacggtctggatgagatcacctgagtagtagatcgacgagatcttgacgaccgtgcggctgttgggggcgtggatcatctgcccgttgccgatgtagatgccgacgtggtggttcgtcgggccactgttnccgaagaagacgaggtcgccgggctgggcctgggacagggggatcttcgtgccgttgttgtactgccactggcttccgtgcgccatgtagacgccgatctgcttgtaggccatgagggtgaggccggagcagtcatagccgaccggcccctcgccgccccagatgtagggcttgccgagttgcgcgtaggcgtagtcgagcaccttctgcttgttgccgctcaccgccggcttggtcggtgcggntggcgtcgtcggtgcggccggcgtcgtcggtgccgtcggcgcggtaggggtggccggtgtcgtcggtgccgtcgggctggtgggagccggggcgttcttggctgcttcagcagctgctgcggccgccgcggctgccgcagcatcgcgcgccgcctgatcggcggccgccttggccgctgcttcccgagcagcggcttcgcgtgctgcagcctgcttggccgcggcgtccgcggccgcctgatcagcggccgccttcgcggccgcttcggcagcggcccgcgcggcggcggcctggcgagccgcctcctcggccgcggcctggcgcgcaaggccgtcctggcgagcctgctcgacctccaccgaggtctggcgcagcgtggccagggtgctgaggcgcgcctgctgctcgccggcgatccggtcagcatccgcttgggcggacgtcgccgcggcctcggccgcaactcgggcggcgcctgccttgncggtggctgcctcacgctgttggcgcgcgacgtcggcggctcggcgatcctccgcggcggtgttggccgtgcgagaggctcggtcgaggtcctgccggcgagtggcgccgatcgcctcgagcgccgccgcacgatccgcaagttgctgagggccactgacctcgagatacgcgcccagcgagtccaggccgccttgcgactgatacatctgcgcggcatacgcacggacgaccttcgcgctggttgccgcctcagcggccgacccggacgcccggcgctcgctttccgccgccttcgcggtggcgtcctcgagagcgagccgggccgagttgtaggcctcggccgccactgcggccgccttgtcgagatcggccaggcgaacgttggccgcggcataggccgactcgatggncgccacggaggcggctgccgcaccggccgcggccttggctgcgtcgacctgctgctgagtgggtgtcccggggtccaggggcancgcaacggcaggtgtcgcgagagccagggcgagcgcgcccacggccagcgggcggaggaccttgaggctggatcgggtcgtcatgggttcacgctgangtggacgtggtcatagtggttctcggtgatggagccacggtcggccatccaacgccactggtcgggaccgttgcccgggaaccagatccgctgcttccagatgatgtatttgatgttgaactgccgtgcattcgcctgagcgaaggcggcnaccgcatcaccctcggcgaaggacttggtcatgacgtcgaccgcgttacccgcgccgtgatcgccccagtcgccggcccggtagccgccgatgttggtgatgccgaaccgggtgcggaccgcggagtagatcgcattggcattggttcccaggcgcgcttgtcggtatgccgtggtgctgtatccgccgccgctggccggggtcgtggcgactggctttggagccgtggccgcaggggctgcggaggttgccggcgtggtcggggtggccggcttggtgaccggctggggtgcctggctggcagcggatgcggccgncttggcggcctgggctgcatc

SEQ ID NO: 1655 - DNA, 4000 bp, Escherichia coli
  misc_feature (609)..(609): n is a, c, g, or t
  misc_feature (637)..(637): n is a, c, g, or t
  misc_feature (1122)..(1122): n is a, c, g, or t
  misc_feature (1985)..(1985): n is a, c, g, or t
  misc_feature (1992)..(1992): n is a, c, g, or t
  misc_feature (2559)..(2559): n is a, c, g, or t
  misc_feature (2821)..(2821): n is a, c, g, or t
  misc_feature (3049)..(3049): n is a, c, g, or t
  misc_feature (3840)..(3840): n is a, c, g, or t
tggctcgcgaattttcaacatacgctacaacggcgatgagcgctaccagcgcaggccctaccgtattcaattccgttacaacagctcgctgaccgcggccgtgcgttgggataaaaagcaccgtggtttcatctgcgatcacctcgcgccttcgcaagaaggtttagaagaacgctggtttgcctacggccctgacttttcgtacgatcgcatctactggtctaatggcaagtggcaattggacgaagcctatccactggtccaaaacttagaggtggcacctaccaataacaatgtgcctaccacactggacccccgaaaataaagcatacaaaaaagccccgcgttgcggggcttttttatatctagtctacaccgcgcgctgcgcggccgagtgtgtacgtttaatgatttaacatcacaggcataacgagcatgagtaagtcttcaccatcgtccatgccgtctgccggtattaaaaggcccgcacggtttggcgcactcatttccatgcgtacgttatcactaccaagattgcttaacatctcaagcaaaaagcgcgaattaaaaccaatctccatatcatcgccttggtagtcgcaagaaatncgttcgtgtgctttattgctaaaatctngatcttcagcacttactgaaatctctgcaccggccagtttcaaacgaatctgatgcgtcgttttattggagaaaatagcgacacgtttcactgaagaggagaatgcgctgcgatcaataagcatcacatttgggttcgactgtggaataaccgcctcatagttcgggtattttccatcgatcaaacgacaaaccaaaacaacattatcaaatgtaaaatgggcgttggtattgttgtacactacctctacttctgaactgtcatagctcaaggaaccgcgaagcatgttcaacggctttttaggcataatgaattcagcagtatccgcagcgcctaaatccgtcctgcggtaacgcaccaacttatgtgcatccgtagcgacgaaggtcagcgaattagattcaaattggaaaaacaccccgctcataactggacgaagctcatcgttaccggtagcgaataatgtttttgtaattcccgtcacnaatgcttctgcaggcaaggtcgcctttgaagaatcttctaactctgggaacttaggaaactcttcgccgtcaatgtaagccaacgaatacttcccgtaatctgaagcgagttcaatggagtgcgcgccttcatcgaaagtaaaggtcaacggctgctctggaaaggtctttaaggtatctaaaagcgtcttggccggaacggcagcagtaccgtggtcttggctttctacttctaaattaacgctcatcatagtctccaaatctgaagcgctgaccgtcaactcaccttgctttaattcaaacaagaaattgtccaatatgggtaaggtattgttgctctgaataatgcctccaatcaattggagttgcttcaagagtttcgaactagatactataaacttcatacgcgttgaatttaatgctcgtaagacaaatataatcgggcaggcgcctttgtaacggcacgcggcccaattttcttatacacaattgttaataatcaaatgcgctgtagatcactgtgcttcagtgaaatcccagcgtaatttcaataagtttctccagccatagcgttgtattaatgccattcgtccgtccggcaattcagcatagaatcgatccggatcccaaacgtgcactgtaccgtcggccgactgctgttgaccttctggctttttataaaacgcgcgggtgcgcaagtggtctccgttggtcgtagtaacgaggagctcgaacgcgggtgtggaggcaaagatactgtccttcttttcccatatgttgtcagacgcaataatggcgccctcgtacttcaaggtctcaatgcttttgaccaccgtgaacagtgccaatggatcgctgaccgntataggntcgtgcgctgctcccaccatggaccaatgctctggtgcggttgccggctcaagtaacgggccggttaaatctgctggattttgacgcgtgatcatccaaccaccgttggggtcttggggcaagaccatttctacatttttaatggcttggggtgccaatccaaaaatggttcgatcgcgccacatggtagactccgtaaagaatcgggtacttaaatacccgttgaatccttgaatgtatacagagaaaggaagctctgcccctaccattttataataggtgcccagcatgtccggcgtttccgtcccaacgatgtagctcttcacgcgttgttcaccaacaaacacctcgatccactttccgtagacctccatacgctgttcaatctcaggtactgcactttcggtaacaaagttttttaatcggacctcgccaactgtctttagtaagacctcgatggcgtcttttcttacaggatgtatgccatctactacccacccgttcgctgtgcgttctaaaactactgaagacggcttcttatcgcggataattaccttggtgatgctngccgtatccggcacggcaaagtcgtactgtgcctttaatgcttctaggccattactctgatccccaccagtgcaagcggttacaataacagcagttaaaaacgaaagactaatcaggttatgaatgcgcatattttcttctgcgtaataggttaaacagcaatgccgcgaggagcaaaagcacctcaggtactgccacatttagaagtttccatttacccgcttcagcaacgagtttttcgccatcgagtagacgcaacttnaaatcacgggtacgggtttgcatcaaacccttatcgtcaagcatgtaatcaacgacattcaatactaaatcatcattgccgtattgtatgcctgtgtattgatcgtaacccaatggcaatggttgaccgcgcggcaattcagggttgattaaattcacttgattgcgaatgaaatcaccgtcgctgaatacagccatggcgctcgtggggctttcctttaattgcggnaaacctttgcctgcagctttcggtgcaatgcgctgggcataggcactggtaaattttccttccaacagcacgcccgtcactaaatcgcgttgcgtaaaggcacgaggatcgggacgattatacaatgcctctaagcttaccgtatgcggcgcagcaaccgatttggaatttactgatgtacgaagcaaaatagacgaacgaatgcctggattttcgagggtatctaaggtcgaagcaaattcacctttgaccgcattcaaattctgaacagagggatgattttgagccgccaaaagcgggaaatatacccaaggctgtatgctcctgcgatcgtttacaccgccgcaacgtacgtcttgtatgacgtcggcattaatccgaacaccgtatttaaaaagtaagtctactatattaagatcatagatagccgggtaggccaagaattcgggaccaaaacttaagctgtccatttcggcatgtaccccatcaataaaccacatgagctttcctccgcccattacgtactgatccagtaggtatttatccaattccgaaaaagcttccgtcggcttcgccacaatagcacatttatacgtattcaagcggcgaaccatatcctgcaagtcagggtcaccgttcggtaaagccttgtaggctgccatagaaaaccggtctaccgtatagttttcgctcaacgccaatccaatgccagccgtttcaacagcactcaactcaccgtgtcctgtgatcatcgcgacctttggcttgtcggtagttagaagcgtatttancgctttcgcaagattaaattccaattgctgaatactaatattgacctgttccgccggttcatagaccattacatcttctagaagtacagccgttgcttcgcgttcttggtagctaagtatggcccctggaaaaacgttgagtacactctgtccgtcctta

SEQ ID NO: 1656 - DNA, 4000 bp, Escherichia coli
  misc_feature (1992)..(1992): n is a, c, g, or t
gattagccaagttatgattacgaatttgattgtagacaaataggttgaaaatgcggtgcataattcaggaagattatcgatgcatccataaaaaatgtcctcgtaatttgtaaaaataaagtcagggacaatactgtacgatgtgtagtcccaaaagcttaccaccaccaccaacaaaagtggcaatataaaaaaaagcccaatcgtgaccatgaagggaagcgctagtagggacgcgccatatttttcaatctgtttcagcatttagaccccggcacgcttttagaccctctttctcaaccctaacttacctggcttcgtaaactagccggcgcttcaccaactataaggtcagccggaggattggtcacaagcaacaatgtataacagcctctttgttaacgacaccagccgtgtcaaacaacaaaaacctaaaccgcgcgagcaaatattcatagtcgtttgttgcgtaaatatagccgggattgccaataaccatcacaccaagagaaattttcggcatcagtcgataacaacgaatcgtggtgttcaatcgttgccaaccaacgactaagtgaaacgaaaaagaaccaaaataaccttcaaactttttaaaaatgagtaaagtgaaatttatggaataaatattttttatagaaattcagtatattaagggaattattttcaaattcagtttaggatgatgtacatgcaaaaaacttttccctaatataaagcgaatacatgaagtaagagtggatatgtctgattgtcgcagcctgcgggcgttcgccggttgttccgttcagcaactgtgatgcgtatgcatgcctgtaataaataaaccaagtctagtgtggtgccgatgtctgaacttgaactgcaaaagcttcaaaaaaaatatggtgaaacaatcgcagtgcgtaaggttgaccttgttttaaacgagtcaaaatattgctgccttttgggtccatctggctgtggaaaaacctcgcttttgcgaatgattgcaggtcatgaggagatttcgtctggttcagttaccataaacggccaagatatttcagaaaaaccgccgtcacttcgaccgacatcaatgatgtttcagaattatgcgctttttcctcatttgaaagtgattgataatgttgcattcgctctcaaaatatccggaatagacaagcccacaagacatgaacgcgccatggaaatgttgcgcggagttcaacttggtaaactagcagatcggtttccaaaccagctatctggtgggcagcagcaaagggttgcacttgctcgtgcgctgattactgagccacgtgtcctgctacttgacgaaccgctctccgctttagacccatttttaaggattgagatgcgagctgagctgaaagcactccagagaaaattggggatctctttcatccacgtgacgcatagtcaagatgaggcgatggcgcttgctgacctaattcttgtcatgaatgacggtattgtggagcagtgcggcacaccgatggaaattttcaataagccgagcaatgcatttgttgcaaattttataggtggccacaacgtattggcgatcggctcgaaattatttgcgataagagaggacagaataaatttgacgcagaatggaaacagtcaggtaaacgccatcgagtttttgggcgctaacgtcaaaattaatgtgagttatggaaaaagtggaaatctgaccgttagccagtctgacgttttgtttgccaaggctaaaattgaggttggcgataatgttaaagtgagctggaataaaaaagatcaattagagctggtcaagtagtggaataacaaaacataagaattcaccaaatccactcgggttctaccgcacaagagcttcctcagagcaaacgtagttattcacggatggactggcaccttttagtttgtggggtgatgcaaataaagcactggagatgcttaaatcgcgatgtagtctattcnatgtgacagtgtaattcttggtgaggctgcttggtgtacattggtgtaacaaatgtcagcgtcatattttaagtcagtaaactgagagaagtgcttggtgactggtgaagcgttgactggggaaaaacaaaaataactggataaaatttgcaaggaggaaagtcaaaatgcaaaaaaacacgacacgtcgtaaggttctcaaaggagcaggcgccgtagcggcttatgctggtttggggcttggtatgccaagcgtagtgcgcgctaacgacaaagtggttcgttatcttggcacagcaaccacaatgggatctgaaatcgacaaaaaactctttgaagacactggtatcaaagtccagtacatccctgtcacaactgatgaagtaacaaaacgtgtgttaactcagcccaacagctttgacattgtcgataccgaatattttagtcttccaaaactagttccatctgggaatatcctgggtatggactcaaaacgtatcaaaaattttgataacataagtacgacccacacacttggagaaatcggtggtaaaaagattggtgaccaaggcactgcgccgaaaaaagtcttttacttgaaggatgaggcctctaaggaattttcctcggagcctactcgatgggcaacgctgatcccgacagttttcaatgctgatactttgggcattaggccagatctgatcggcaggccaattgacacatgggccgagcttttgaacccagagtttaagggaaaagcatcgatcttaaatatcccatcaattggaattatggatgccgcaatggtcgttgaatcaatgggtgaatataaatacccagacaaaggcaacatgacgcgtaaagagattgatatgacaatcggcatattaatcgaagcaaagaaacagggacaatttcgggctctctggtccgatttcaacgaaagcgtcaatttgatggcgtctggtgaagtagtaattcagtcaatgtggtcgccagcaattaccgccgttcggacgcagggcattccttgcatatatcaaccattgaaggaaggatatcgtgcttgggctgtgggctttgccttgtctgctgctaccaaaggctatcaagcagatgtttgttatgaattcatcaattggtatctctctggtttcgttggtggatatctaaaccgtcagggttactattcagctgtaccatcaactgccaaagaatacatggctgcctacgagtgggattactggatgcttggaaagcctgcaacacaggacataatggctccagatggcaaaaagctggctggtgctggtgaagtcagagatggtggatctttcgaagagcggatgggcggcgttgcttgttggaacgcaacaatggatgagaaccgttacatggtgcgtaaatggaatgaatttgtcgcagcgtaaatgcacctaactataaaatattcggcacccttttgggtgccgttttttttctgaagtggaaatttggatatggatgggtctgaatgtgcgaaactacaacgcgccaaggggcaattgagttttcacgtgagccaaaaacgtgtttcgcgcatgttccagtcaggctcggcgaagcttatgctgccaaaaacttactctgatatgatggaagcagtcattctcaacacctcaggcggtatgactggtggcgacattttaaatatcgatgttgaggctaaggattgcgcgcttgtgatgacaacgcaaactgctgaacgtgtgtatcgtagcgttggtaaaaggtctgcaaagatgcagatcaacctctcagtctctgatacagcagatctgcattggctgccccaagaaacgatcgtattcaatcactccaaatttgaacggacgctgaaaataaatttgtcttcctgcagcaactgtttagttgccgagacaattgttttgggccgtcaagccatgggcgagaatgtttatgattgccatttaattgataattggcgcgtgttccgtgacggcaattt

SEQ ID NO: 1657 - DNA, 4000 bp, Escherichia coli
  misc_feature (714)..(714): n is a, c, g, or t
  misc_feature (1946)..(1946): n is a, c, g, or t
  misc_feature (1975)..(1975): n is a, c, g, or t
  misc_feature (1981)..(1981): n is a, c, g, or t
  misc_feature (1985)..(1985): n is a, c, g, or t
  misc_feature (2185)..(2185): n is a, c, g, or t
  misc_feature (3319)..(3319): n is a, c, g, or t
gccggcgggttttccctttttgaacaaggggacttgaaaggagggatgctccacccataatccgtattcatcataacccatcacttttacataaattttatttttctcgattcccaattcttttagcgggtcatgtccgtctaggacgagtaaaaccacatcattcaaaatttcatctattttcatgggaggtttatccattttcagctcctttagttttcgccaacaattttatacacaccaccattgtaatcaataatatataattcaccatctgcatcttctccaaaggaagaaatatagttggtgaactctccgtcggcgatattgatttcctccgttcggttttggaattcaactgctttgccgttttttactttaaacgtccaaatattcccggagcagtaatccccaaaaaagtacgttccttttaatcctttaattttttcccctcggtaaacatatcccccggttacagaacatccatcaacatcgggctggtccattcctgttaaggttcgcatataattggcatcgtttgggtattcaaggatcggaatcgtcaaaccagttttaggacaattttcttcgggatcatagcaatgattggcttccatgatccgccaaccatagttgataccacccttgctgctccccggttcataattaatttcctcccatttattttggcccacatctccaatatataaatcnccattttcccggtcaaatgaaaagcgccagggattccgcaatccccaagcccagatttctccccgcttgttttcttgtccgtaataggggtttgtttcagggatgccatagggaatttgatttacgtcaattcggatcagtttcccaaaaagggtatttaaatcttgcccggccttgaatgggtctccagcctttcccccgtcgcccacggaaatatataagtacccatcaggtccaaaatccatgtggccgccattatgatttgagaaaggttgtttcaggtcaaacaaaatacgttcagacgtatgatcagctctttgcttattttttataatgaattctgacactactgtataaccgtcattgttcatataattcacataaaattttctattttttctatgatttggatggaatgcaaatcccagcaatccccgttcgtctcctgggcgatttggattcaccacgcgttttccgatatccaagaatggcgttttaagtttttctccattctgaataatcataattttcccagcttgttcaaccacataaagtagtgttgcatcgttgggatgtgatgcgacataaaggggttttttaaaaccgtcggcaatttcaatagatgaaagtgctgacgtttggctaaataatagaatgggaagaatgaatatgaattgttttaacatatgggaaattaacaaaagattatcaaagtcttctgactttgatttgggggtaggagatcccaaaaaatctttgttttgtctcttaattatttgttgttgatttattataaaggaattgaaatttttagaagaggtgttcttgttggtttgttttgattggtttcaaatatggaatgaatatatctccccgttatccaacccaatacccatccagcaagtacgtcagagacataatggtttcccacataaacttggctgtaaccactcaaaagtgtataaccaatcatgatagaggtattttttggagaagaaagcgccaatgacgttgcccatgcagccgttgtggccgcatgaccggaaggaaaagaaggtgtaaatcgtgtattccaaagtctgggattatattgtctttctggacggcttcgtttaaaagcatatttagaaataataatgggtagttgaacaatcatagcagttgccaagtgtggtctcagtttgtcgtgaccaatctgatcaaacccggaaaatccgaattcaatgaagggngtagccagggcgaagctttccatggcaanatccancggnggggaattatttttcccttcaagaaaagatgacagagattgatctgtttgtgtcattttattttgagtgaaggaaatagaactatataaaagaaatatggtaaggattttcattttagcctatcaaggaattctgcttcagataaaacagggatatccaattcagttgctttttttaacttagatccggcgcctggcccngccacaacaaaatcagtatttttactaaccgatccgctgacttttcccccatgtgcttcagtcatttcttttgcttcattccggctgaattgggttaaggcacctgtaaaaacaaatgtttttccttgaagcaacaggcttttgggtttttcaactttttttaatcgaatgcctaaagataagcaggattctattacattcgtattggtgcagttagataaaaatgtcgtaatagtttctgccacgatgggacccacttcatcaatggcttccagttcttcttcagcagctttcataaatttttctatgtcacccacaaaagctttttcaaggaccttagataaatgtgctcccacatttcgaatgccaagtgcatagacaaatcgtgcaaaagtggtttgttttgaatcttgaatagctgttaaaatattaagtgcagatttttctgccatacgatctaggttgaccaaatcatcaaaattgagtttaaatatatcatccacagtcagaatcaattttttatcaaccagttgatctaccagcttttcaccaaaaccatcaatatctaatgcccctttggatacaaaatgttctatgcggccttttacctgggcagggcaggagaggttttgacatcgggttaccacttctccttctggccgggacacctcttgcccacaagaaggacattctgttggaagttgatacgtttttgtttctggagggcgtttggcagggatgactttcaccacctctggtattacatctcccgcccgctggattaataccgtatcgccaactcggacatcttttcgatcaatttcatcctgattgtgcaaggttgcattggtcacaaccacaccaccaacattgacaggctcaagacgggcaaccggcgttacagcaccggtccggcccacggatggaataatattctgaaccagggtagtggcttgctgagctttgaatttacctgcgattgcccatcgcggggatcggctgcggatacccaatgcgtttcgttgattgattacatttactttaaatacggtgccgtcaattccatagggtaatgaatctcgtttggcttccaggttacgatgaaacgcaaccatcgtctcagcattgtttacnttttgtatttctgggtttaccgggaatccccattcttttaatgtggacaaaaaatcctcgtgtgtatcaaaagaaataccatcaattcttcctgcttcataacaataaatagataaaggtcttgttgccgtaatttttgaatcgagttgacgaagacttcccgcagcagcatttcttggattggcaaagggggagagctcctctttttcttgattccgattcagcttcttgaatccatccttggtaataaagacttctcctcgcacttctaacaaaggtggggttttttgcccgttttttcgtaaagacaggggaatcgccgtgattgtttttaagttttgggtaatatcctcacccgtaattccgtctccccgagtggatccatttacgaaaaatccattttcatacacgagttcaaccgcaagcccatccaattttggttccgccatatattcaagatctttttctgtatccaggccttttttgacccgggtgtcaaaggcagccaattcatcctcattcatggcgtttgccagagacagcatgggcatgcgatgtgtccaggaaccaaaagaagataatggttctgctcccacacggcgtgtgggagaatcttctgtaattaaattaggattatcagtctcaagcttttgcaattctctgaaaagctgatcatattca

SEQ ID NO: 1658 - DNA, 4000 bp, Escherichia coli
  misc_feature (287)..(287): n is a, c, g, or t
  misc_feature (344)..(344): n is a, c, g, or t
  misc_feature (1266)..(1266): n is a, c, g, or t
  misc_feature (2519)..(2519): n is a, c, g, or t
tcgctaagatcatagctcctggggtctcgaccctgcagctggacaagcgcgctgaggagttcatccgtgacaacggtgcgactcccgccttcctcggctacaatggcttccctgggagtctctgcacctcggtcaatgaccatgtggtgcacgggatcccttcctcgaaggtcgtactcaaggacggtgacatcgtctccgtcgactgcggcacgaagctcgcaggcttcactggggactccgcctacacgttcgctgtaggtgaggtagctcccgagactctggcnctccttcgcacgacgaaggaatccctctacatcggcatcgagcatgctgtagcgggnaagcgcgtcggtgatatcggcgctgcggtccagcagtattgtgaggcacgtggctatcatatcgtccgcgaacttgaaggccacgggatcgggaagaatatgcatgaggagccaggtgtgcccaacttcgggcgccgtggcacggggcctgagctccgctctgggatgtgcatctgcatcgagccaatggtgaacatgggctcgaagaatgtcatcttcgatcgcgatggctggaccgtccgtactaagacgggcaagccttcagcccacttcgagcactgcgtcgctatccgcgatggcaaggccgatatcctctcttcgtttgactttatcaaggaagtcttggtagacagagagttttaatctcgcaaccacagtatatgccgaagcaagcagcaatagaactcgacggtgtcatcctcgaagcgctctcgaacgcaatgttcaaggtcgagctcgagaacggacacgtcatcaccgcccacatctctgggaagatgcgtatgcactacatcaagatcctcccaggtgacaaggtcaaggtagagatgtctccctacgacttgactaaggggcgtatatcattcagatataaataaccctatatagatatgaaagtaagagcatcactcaagaagcgcaccgccgactgcaagatcgttcgtcgcaaggggcgtctgtacgtaatcaacaagaagaaccccaagttcaagcaacgccaggggtagtctctaaccatcggactatattttaacgaactaagataagtatggctatcagaattgttggcgtcgacttgccacaaaacaaacgaggagaaattgccttgacttacatcttcgggatcggtcgtagcagcgctaccaagatcctcgataaggctggggtcgatcgcaatatcaaggtaaaggactggaccgangaccaggctgccgctatccgtgaggtgatcggtgccgagtacaaggtcgaaggggatctgcgctccgaagtccagctcaacatcaagcgactgatggacatcggttgctaccgtggtgtccgccaccgtatcggtctgcctctacgcggtcagagtacgaagaacaatgctcgtactcgtaagggtaagaagaagactgtcgcaaataagaagaaagctactaagtaatagagattgatatggcaaagaaagtagtcgcaaagaagaaggtcgtcaagatcgacgctgtgggccaggctcacatccactcttcttttaataacatcatcatctctctgaccaacaacgaaggtcaggtcatcagctggtcttcggctggtaagatgggattccgtagctctaagaagaacaccccttacgctgctcagatggcggcccaggattgcgctaaggtcgcttacgacctcggtctgcgcaaggtcaaggtcttcgtcaagggtccaggtaacggccgtgagtctgctatccgcaccatccatggcgctggtatcgaagtcactgagatcgtcgacgtgaccccaatgccacacaatggctgccgtcctcctaagcgtcgtcgcgtctaatccctgacttcgcttcagatcacagagtagtttcataaagatcgcagtacactcccagagacgcttcgctcaccgtgctccctccatcgagcacaagggcgcgagcgaacgctaagagtcctgagctaagcaaggcgccgaggtagacgacgagtgaaagattggctatactttcatatatctatcctctcctcataaccggtcgcggctgcactccgcctccctcccgccacccgctgctctctgcctccagcgttgcctctccccgagaggtcgctcgtactgcttcaacaatagaagacaatggcaagatatacaggtccaaaatcaaagatcgcccgtaagcttggcgcacctatcttcggtgccgacaaggtactctccaagaagaactatcctcctggacagcacggcaacaaccgccgtcgtaagacgagcgaatatggcatccagctcaaggaaaagcagaaggctaagtacacctatggcgtactcgagcgtcagttccgcaacctcttcgaaaaggctcagcgcacgaagggtgtcacgggtgaagtgctcctccagctcctggaaagccgcctcgacaacgtcgtctatcgcctcggcatcgctaagacgcgtgcngctgctcgtcagctcgtctcgcaccgtcacatcaccgtcgatggtcaggtagtcaacatcccttcttacaccctcaagcccggccaggtcgtcggcgtccgtgagaaggcgaagagcttagaggtcatcaccgactctctggctggtcgtagccacagcagctacagctggctcgagtggaatcaggcttctctctccggtaagttcctcagcgctcctcagcgtgaagacatccccgaagagatcaaggagcagctgatcgtcgaactatactctaagtaataatccctattatctcactcacatggcaatattagcatttcagaagcccgaaaacgtcctcatgatggatgcgacggactcgtacgctaagttcgagttccgccctcttgagccgggatatggtaccactgtcggtaatgccctgcgtcgtatactcctttcttcactcgaaggctacgccatctcgaccatcaagatcgaaggtgtcaatcatgaatttgctactattccgggtgtcttggaggatgtaactaacatcattctcaacctgaagcaagtccgcttccgtgccctcgtccaggacgctactgaggagaccgtcagcctgacgatctctggtcagcagcagttcctcgctggcgagctcaacggcaagcttacttccttcgaagtcctcaatcccgagctggtcatctgccacatcgatgaggcgtatacccttactatcgagctctccatcaacaaggggcgtggttacatccccgctgatgagaagctggtcgacacggctcaggagaatgagctgcagacgatcgctatcgactcgatctatacgcctatccgtaatgtcaagtacttcacggagaactatcgtgtagagcagaagactgactacgagaagctgaccctcgagatcaccactgacgggagcattcatccccagcaggctctcaaggacgcagcagctatcctcatcgagcacttcagcctcttcatctctgaccctgtcgaggtagaagagaatgcagtcatcgaggaaggcgacgaggaggtactggacatgcaggagatcgatcgcgtatctcagctgctccgtactgatctcaaggatctcgatctctccgtccgtgcgcagaactgcctccgctccggcaacgtattccgtctggccgacctcgtcgtcctcgacgctgatacgctcagcaagttccgcaacttcggtaagaagtctatggacgagctcaacgagctgatggagcgactcggactcaccttcgggatggatgttagcaagtacaatttagataatgactaagtagaaagatgagacataataagaaattcaatcatctcggtcgtaagaaggcgcaccgcgaggctatgctttccaacatggctgcatcgctcatcctgcacaagcgcatcttcaccacggtcgctaaggctaaggctcttcgcgtatacgtcgagcccctgct

SEQ ID NO: 1659 - DNA, 4000 bp, Escherichia coli
  misc_feature (54)..(54): n is a, c, g, or t
  misc_feature (129)..(129): n is a, c, g, or t
  misc_feature (135)..(135): n is a, c, g, or t
  misc_feature (156)..(156): n is a, c, g, or t
  misc_feature (160)..(160): n is a, c, g, or t
  misc_feature (162)..(162): n is a, c, g, or t
  misc_feature (168)..(168): n is a, c, g, or t
  misc_feature (171)..(171): n is a, c, g, or t
  misc_feature (181)..(181): n is a, c, g, or t
  misc_feature (184)..(186): n is a, c, g, or t
  misc_feature (192)..(192): n is a, c, g, or t
  misc_feature (198)..(198): n is a, c, g, or t
  misc_feature (201)..(201): n is a, c, g, or t
  misc_feature (213)..(213): n is a, c, g, or t
  misc_feature (218)..(218): n is a, c, g, or t
  misc_feature (222)..(224): n is a, c, g, or t
  misc_feature (246)..(246): n is a, c, g, or t
  misc_feature (303)..(303): n is a, c, g, or t
  misc_feature (327)..(327): n is a, c, g, or t
  misc_feature (393)..(393): n is a, c, g, or t
  misc_feature (417)..(417): n is a, c, g, or t
  misc_feature (442)..(442): n is a, c, g, or t
  misc_feature (453)..(453): n is a, c, g, or t
  misc_feature (482)..(482): n is a, c, g, or t
  misc_feature (504)..(504): n is a, c, g, or t
  misc_feature (589)..(589): n is a, c, g, or t
  misc_feature (591)..(591): n is a, c, g, or t
  misc_feature (600)..(600): n is a, c, g, or t
  misc_feature (615)..(615): n is a, c, g, or t
  misc_feature (652)..(652): n is a, c, g, or t
  misc_feature (696)..(696): n is a, c, g, or t
  misc_feature (699)..(699): n is a, c, g, or t
  misc_feature (758)..(759): n is a, c, g, or t
  misc_feature (774)..(775): n is a, c, g, or t
  misc_feature (777)..(777): n is a, c, g, or t
  misc_feature (780)..(780): n is a, c, g, or t
  misc_feature (800)..(800): n is a, c, g, or t
  misc_feature (820)..(821): n is a, c, g, or t
  misc_feature (1794)..(1794): n is a, c, g, or t
  misc_feature (1927)..(1927): n is a, c, g, or t
  misc_feature (2148)..(2149): n is a, c, g, or t
  misc_feature (2195)..(2195): n is a, c, g, or t
  misc_feature (2203)..(2203): n is a, c, g, or t
  misc_feature (2210)..(2210): n is a, c, g, or t
  misc_feature (2212)..(2212): n is a, c, g, or t
  misc_feature (2218)..(2218): n is a, c, g, or t
  misc_feature (2222)..(2222): n is a, c, g, or t
  misc_feature (2240)..(2240): n is a, c, g, or t
  misc_feature (2243)..(2243): n is a, c, g, or t
  misc_feature (2246)..(2247): n is a, c, g, or t
  misc_feature (2250)..(2250): n is a, c, g, or t
  misc_feature (2263)..(2264): n is a, c, g, or t
  misc_feature (2275)..(2275): n is a, c, g, or t
  misc_feature (2277)..(2277): n is a, c, g, or t
  misc_feature (2281)..(2281): n is a, c, g, or t
  misc_feature (2309)..(2309): n is a, c, g, or t
  misc_feature (2313)..(2313): n is a, c, g, or t
  misc_feature (2319)..(2319): n is a, c, g, or t
  misc_feature (2321)..(2321): n is a, c, g, or t
  misc_feature (2323)..(2323): n is a, c, g, or t
  misc_feature (2335)..(2335): n is a, c, g, or t
  misc_feature (2338)..(2338): n is a, c, g, or t
  misc_feature (2346)..(2346): n is a, c, g, or t
  misc_feature (2352)..(2352): n is a, c, g, or t
  misc_feature (2354)..(2355): n is a, c, g, or t
  misc_feature (2359)..(2359): n is a, c, g, or t
  misc_feature (2388)..(2388): n is a, c, g, or t
  misc_feature (2432)..(2434): n is a, c, g, or t
  misc_feature (2442)..(2442): n is a, c, g, or t
  misc_feature (2448)..(2449): n is a, c, g, or t
  misc_feature (2452)..(2453): n is a, c, g, or t
  misc_feature (2458)..(2461): n is a, c, g, or t
  misc_feature (2463)..(2463): n is a, c, g, or t
  misc_feature (2468)..(2469): n is a, c, g, or t
  misc_feature (2471)..(2471): n is a, c, g, or t
  misc_feature (2474)..(2474): n is a, c, g, or t
  misc_feature (2481)..(2481): n is a, c, g, or t
  misc_feature (2483)..(2483): n is a, c, g, or t
  misc_feature (2486)..(2487): n is a, c, g, or t
  misc_feature (2489)..(2490): n is a, c, g, or t
  misc_feature (2493)..(2495): n is a, c, g, or t
  misc_feature (2500)..(2502): n is a, c, g, or t
  misc_feature (2505)..(2505): n is a, c, g, or t
  misc_feature (2507)..(2508): n is a, c, g, or t
  misc_feature (2510)..(2515): n is a, c, g, or t
  misc_feature (2517)..(2518): n is a, c, g, or t
  misc_feature (2520)..(2523): n is a, c, g, or t
  misc_feature (2526)..(2528): n is a, c, g, or t
  misc_feature (2532)..(2533): n is a, c, g, or t
  misc_feature (2535)..(2535): n is a, c, g, or t
  misc_feature (2538)..(2539): n is a, c, g, or t
  misc_feature (2541)..(2541): n is a, c, g, or t
  misc_feature (2544)..(2544): n is a, c, g, or t
  misc_feature (2547)..(2547): n is a, c, g, or t
  misc_feature (2549)..(2550): n is a, c, g, or t
  misc_feature (2552)..(2552): n is a, c, g, or t
  misc_feature (2555)..(2556): n is a, c, g, or t
  misc_feature (2558)..(2558): n is a, c, g, or t
  misc_feature (2560)..(2560): n is a, c, g, or t
  misc_feature (2562)..(2562): n is a, c, g, or t
  misc_feature (2564)..(2565): n is a, c, g, or t
  misc_feature (2567)..(2567): n is a, c, g, or t
  misc_feature (2570)..(2574): n is a, c, g, or t
  misc_feature (2576)..(2578): n is a, c, g, or t
  misc_feature (2581)..(2583): n is a, c, g, or t
  misc_feature (2585)..(2589): n is a, c, g, or t
  misc_feature (2591)..(2591): n is a, c, g, or t
  misc_feature (2593)..(2596): n is a, c, g, or t
  misc_feature (2600)..(2601): n is a, c, g, or t
  misc_feature (2603)..(2604): n is a, c, g, or t
  misc_feature (2615)..(2616): n is a, c, g, or t
  misc_feature (2618)..(2618): n is a, c, g, or t
  misc_feature (2621)..(2621): n is a, c, g, or t
  misc_feature (2625)..(2625): n is a, c, g, or t
  misc_feature (2627)..(2628): n is a, c, g, or t
  misc_feature (2630)..(2631): n is a, c, g, or t
  misc_feature (2633)..(2633): n is a, c, g, or t
  misc_feature (2636)..(2637): n is a, c, g, or t
  misc_feature (2641)..(2641): n is a, c, g, or t
  misc_feature (2643)..(2643): n is a, c, g, or t
  misc_feature (2646)..(2647): n is a, c, g, or t
  misc_feature (2649)..(2651): n is a, c, g, or t
  misc_feature (2655)..(2658): n is a, c, g, or t
  misc_feature (2660)..(2660): n is a, c, g, or t
  misc_feature (2663)..(2663): n is a, c, g, or t
  misc_feature (2665)..(2666): n is a, c, g, or t
  misc_feature (2668)..(2668): n is a, c, g, or t
  misc_feature (2670)..(2670): n is a, c, g, or t
  misc_feature (2673)..(2674): n is a, c, g, or t
  misc_feature (2679)..(2679): n is a, c, g, or t
  misc_feature (2681)..(2683): n is a, c, g, or t
  misc_feature (2686)..(2687): n is a, c, g, or t
  misc_feature (2690)..(2690): n is a, c, g, or t
  misc_feature (2692)..(2693): n is a, c, g, or t
  misc_feature (2695)..(2695): n is a, c, g, or t
  misc_feature (2701)..(2701): n is a, c, g, or t
  misc_feature (2703)..(2703): n is a, c, g, or t
  misc_feature (2705)..(2705): n is a, c, g, or t
  misc_feature (2707)..(2709): n is a, c, g, or t
  misc_feature (2715)..(2715): n is a, c, g, or t
  misc_feature (2717)..(2718): n is a, c, g, or t
  misc_feature (2720)..(2723): n is a, c, g, or t
  misc_feature (2727)..(2727): n is a, c, g, or t
  misc_feature (2730)..(2731): n is a, c, g, or t
  misc_feature (2733)..(2733): n is a, c, g, or t
  misc_feature (2738)..(2738): n is a, c, g, or t
  misc_feature (2740)..(2742): n is a, c, g, or t
  misc_feature (2745)..(2746): n is a, c, g, or t
  misc_feature (2748)..(2749): n is a, c, g, or t
  misc_feature (2751)..(2752): n is a, c, g, or t
  misc_feature (2754)..(2754): n is a, c, g, or t
  misc_feature (2756)..(2760): n is a, c, g, or t
  misc_feature (2767)..(2768): n is a, c, g, or t
  misc_feature (2771)..(2772): n is a, c, g, or t
  misc_feature (2776)..(2778): n is a, c, g, or t
  misc_feature (2780)..(2782): n is a, c, g, or t
  misc_feature (2789)..(2791): n is a, c, g, or t
  misc_feature (2795)..(2795): n is a, c, g, or t
  misc_feature (2798)..(2799): n is a, c, g, or t
  misc_feature (2802)..(2802): n is a, c, g, or t
  misc_feature (2804)..(2804): n is a, c, g, or t
  misc_feature (2807)..(2811): n is a, c, g, or t
  misc_feature (2813)..(2814): n is a, c, g, or t
  misc_feature (2816)..(2816): n is a, c, g, or t
  misc_feature (2820)..(2823): n is a, c, g, or t
  misc_feature (2825)..(2829): n is a, c, g, or t
  misc_feature (2831)..(2832): n is a, c, g, or t
  misc_feature (2834)..(2836): n is a, c, g, or t
  misc_feature (2838)..(2839): n is a, c, g, or t
  misc_feature (2842)..(2842): n is a, c, g, or t
  misc_feature (2844)..(2845): n is a, c, g, or t
  misc_feature (2847)..(2850): n is a, c, g, or t
  misc_feature (2852)..(2853): n is a, c, g, or t
  misc_feature (2855)..(2857): n is a, c, g, or t
  misc_feature (2859)..(2860): n is a, c, g, or t
  misc_feature (2865)..(2871): n is a, c, g, or t
  misc_feature (2873)..(2873): n is a, c, g, or t
  misc_feature (2875)..(2880): n is a, c, g, or t
  misc_feature (2882)..(2883): n is a, c, g, or t
  misc_feature (2885)..(2886): n is a, c, g, or t
  misc_feature (2889)..(2890): n is a, c, g, or t
  misc_feature (2892)..(2897): n is a, c, g, or t
  misc_feature (2899)..(2901): n is a, c, g, or t
  misc_feature (2903)..(2903): n is a, c, g, or t
  misc_feature (2906)..(2914): n is a, c, g, or t
  misc_feature (2916)..(2916): n is a, c, g, or t
  misc_feature (2920)..(2920): n is a, c, g, or t
  misc_feature (2923)..(2923): n is a, c, g, or t
  misc_feature (2925)..(2938): n is a, c, g, or t
  misc_feature (2940)..(2942): n is a, c, g, or t
  misc_feature (2944)..(2950): n is a, c, g, or t
  misc_feature (2952)..(2959): n is a, c, g, or t
  misc_feature (2962)..(2963): n is a, c, g, or t
  misc_feature (2965)..(2965): n is a, c, g, or t
  misc_feature (2967)..(2971): n is a, c, g, or t
  misc_feature (2974)..(2976): n is a, c, g, or t
  misc_feature (2978)..(2982): n is a, c, g, or t
  misc_feature (2984)..(2984): n is a, c, g, or t
  misc_feature (2986)..(2991): n is a, c, g, or t
  misc_feature (2993)..(2994): n is a, c, g, or t
  misc_feature (2996)..(2997): n is a, c, g, or t
  misc_feature (2999)..(3001): n is a, c, g, or t
  misc_feature (3003)..(3004): n is a, c, g, or t
  misc_feature (3006)..(3008): n is a, c, g, or t
  misc_feature (3011)..(3013): n is a, c, g, or t
  misc_feature (3015)..(3021): n is a, c, g, or t
  misc_feature (3023)..(3028): n is a, c, g, or t
  misc_feature (3030)..(3034): n is a, c, g, or t
  misc_feature (3038)..(3039): n is a, c, g, or t
  misc_feature (3042)..(3042): n is a, c, g, or t
  misc_feature (3044)..(3044): n is a, c, g, or t
  misc_feature (3047)..(3049): n is a, c, g, or t
  misc_feature (3051)..(3054): n is a, c, g, or t
  misc_feature (3056)..(3057): n is a, c, g, or t
  misc_feature (3062)..(3063): n is a, c, g, or t
  misc_feature (3065)..(3066): n is a, c, g, or t
  misc_feature (3071)..(3071): n is a, c, g, or t
  misc_feature (3075)..(3077): n is a, c, g, or t
  misc_feature (3079)..(3080): n is a, c, g, or t
  misc_feature (3083)..(3086): n is a, c, g, or t
  misc_feature (3090)..(3090): n is a, c, g, or t
  misc_feature (3093)..(3102): n is a, c, g, or t
  misc_feature (3104)..(3104): n is a, c, g, or t
  misc_feature (3106)..(3111): n is a, c, g, or t
  misc_feature (3113)..(3113): n is a, c, g, or t
  misc_feature (3115)..(3120): n is a, c, g, or t
  misc_feature (3123)..(3123): n is a, c, g, or t
  misc_feature (3125)..(3127): n is a, c, g, or t
  misc_feature (3129)..(3129): n is a, c, g, or t
  misc_feature (3131)..(3132): n is a, c, g, or t
  misc_feature (3134)..(3135): n is a, c, g, or t
  misc_feature (3137)..(3146): n is a, c, g, or t
  misc_feature (3148)..(3148): n is a, c, g, or t
  misc_feature (3150)..(3150): n is a, c, g, or t
  misc_feature (3152)..(3153): n is a, c, g, or t
  misc_feature (3156)..(3162): n is a, c, g, or t
  misc_feature (3164)..(3164): n is a, c, g, or t
  misc_feature (3166)..(3170): n is a, c, g, or t
  misc_feature (3173)..(3174): n is a, c, g, or t
  misc_feature (3176)..(3180): n is a, c, g, or t
  misc_feature (3182)..(3183): n is a, c, g, or t
  misc_feature (3185)..(3185): n is a, c, g, or t
  misc_feature (3187)..(3189): n is a, c, g, or t
  misc_feature (3191)..(3192): n is a, c, g, or t
  misc_feature (3194)..(3197): n is a, c, g, or t
  misc_feature (3199)..(3201): n is a, c, g, or t
  misc_feature (3203)..(3203): n is a, c, g, or t
  misc_feature (3205)..(3207): n is a, c, g, or t
  misc_feature (3209)..(3210): n is a, c, g, or t
  misc_feature (3212)..(3213): n is a, c, g, or t
  misc_feature (3215)..(3221): n is a, c, g, or t
  misc_feature (3223)..(3226): n is a, c, g, or t
  misc_feature (3228)..(3230): n is a, c, g, or t
  misc_feature (3234)..(3234): n is a, c, g, or t
  misc_feature (3237)..(3246): n is a, c, g, or t
  misc_feature (3248)..(3249): n is a, c, g, or t
  misc_feature (3252)..(3257): n is a, c, g, or t
  misc_feature (3259)..(3261): n is a, c, g, or t
  misc_feature (3263)..(3264): n is a, c, g, or t
  misc_feature (3266)..(3270): n is a, c, g, or t
  misc_feature (3272)..(3279): n is a, c, g, or t
  misc_feature (3281)..(3282): n is a, c, g, or t
  misc_feature (3284)..(3285): n is a, c, g, or t
  misc_feature (3287)..(3290): n is a, c, g, or t
  misc_feature (3292)..(3295): n is a, c, g, or t
  misc_feature (3299)..(3300): n is a, c, g, or t
  misc_feature (3302)..(3303): n is a, c, g, or t
  misc_feature (3305)..(3306): n is a, c, g, or t
  misc_feature (3308)..(3308): n is a, c, g, or t
  misc_feature (3311)..(3311): n is a, c, g, or t
  misc_feature (3314)..(3319): n is a, c, g, or t
  misc_feature (3321)..(3324): n is a, c, g, or t
  misc_feature (3326)..(3327): n is a, c, g, or t
  misc_feature (3329)..(3330): n is a, c, g, or t
  misc_feature (3332)..(3333): n is a, c, g, or t
  misc_feature (3335)..(3362): n is a, c, g, or t
  misc_feature (3364)..(3366): n is a, c, g, or t
  misc_feature (3369)..(3372): n is a, c, g, or t
  misc_feature (3374)..(3375): n is a, c, g, or t
  misc_feature (3379)..(3381): n is a, c, g, or t
  misc_feature (3383)..(3384): n is a, c, g, or t
  misc_feature (3387)..(3390): n is a, c, g, or t
  misc_feature (3393)..(3393): n is a, c, g, or t
  misc_feature (3395)..(3396): n is a, c, g, or t
  misc_feature (3398)..(3405): n is a, c, g, or t
  misc_feature (3407)..(3408): n is a, c, g, or t
  misc_feature (3410)..(3411): n is a, c, g, or t
  misc_feature (3413)..(3414): n is a, c, g, or t
  misc_feature (3417)..(3417): n is a, c, g, or t
  misc_feature (3419)..(3423): n is a, c, g, or t
  misc_feature (3425)..(3425): n is a, c, g, or t
  misc_feature (3428)..(3429): n is a, c, g, or t
  misc_feature (3431)..(3432): n is a, c, g, or t
  misc_feature (3434)..(3440): n is a, c, g, or t
  misc_feature (3443)..(3444): n is a, c, g, or t
  misc_feature (3446)..(3447): n is a, c, g, or t
  misc_feature (3449)..(3453): n is a, c, g, or t
  misc_feature (3457)..(3457): n is a, c, g, or t
  misc_feature (3462)..(3462): n is a, c, g, or t
  misc_feature (3464)..(3464): n is a, c, g, or t
  misc_feature (3468)..(3468): n is a, c, g, or t
  misc_feature (3471)..(3472): n is a, c, g, or t
  misc_feature (3474)..(3474): n is a, c, g, or t
  misc_feature (3476)..(3477): n is a, c, g, or t
  misc_feature (3482)..(3483): n is a, c, g, or t
  misc_feature (3485)..(3487): n is a, c, g, or t
  misc_feature (3489)..(3489): n is a, c, g, or t
  misc_feature (3491)..(3495): n is a, c, g, or t
  misc_feature (3498)..(3501): n is a, c, g, or t
  misc_feature (3504)..(3504): n is a, c, g, or t
  misc_feature (3506)..(3516): n is a, c, g, or t
  misc_feature (3519)..(3520): n is a, c, g, or t
  misc_feature (3522)..(3522): n is a, c, g, or t
  misc_feature (3525)..(3525): n is a, c, g, or t
  misc_feature (3527)..(3528): n is a, c, g, or t
  misc_feature (3530)..(3530): n is a, c, g, or t
  misc_feature (3535)..(3537): n is a, c, g, or t
  misc_feature (3539)..(3540): n is a, c, g, or t
  misc_feature (3542)..(3553): n is a, c, g, or t
  misc_feature (3555)..(3556): n is a, c, g, or t
  misc_feature (3558)..(3559): n is a, c, g, or t
  misc_feature (3561)..(3562): n is a, c, g, or t
  misc_feature (3564)..(3565): n is a, c, g, or t
  misc_feature (3567)..(3568): n is a, c, g, or t
  misc_feature (3571)..(3573): n is a, c, g, or t
  misc_feature (3579)..(3579): n is a, c, g, or t
  misc_feature (3581)..(3582): n is a, c, g, or t
  misc_feature (3584)..(3584): n is a, c, g, or t
  misc_feature (3587)..(3588): n is a, c, g, or t
  misc_feature (3590)..(3594): n is a, c, g, or t
  misc_feature (3596)..(3597): n is a, c, g, or t
  misc_feature (3599)..(3603): n is a, c, g, or t
  misc_feature (3605)..(3605): n is a, c, g, or t
  misc_feature (3608)..(3609): n is a, c, g, or t
  misc_feature (3611)..(3615): n is a, c, g, or t
  misc_feature (3618)..(3620): n is a, c, g, or t
  misc_feature (3623)..(3624): n is a, c, g, or t
  misc_feature (3627)..(3627): n is a, c, g, or t
  misc_feature (3629)..(3630): n is a, c, g, or t
  misc_feature (3634)..(3635): n is a, c, g, or t
  misc_feature (3637)..(3637): n is a, c, g, or t
  misc_feature (3642)..(3642): n is a, c, g, or t
  misc_feature (3645)..(3648): n is a, c, g, or t
  misc_feature (3650)..(3650): n is a, c, g, or t
  misc_feature (3653)..(3653): n is a, c, g, or t
  misc_feature (3655)..(3660): n is a, c, g, or t
  misc_feature (3662)..(3662): n is a, c, g, or t
  misc_feature (3664)..(3664): n is a, c, g, or t
  misc_feature (3666)..(3666): n is a, c, g, or t
  misc_feature (3668)..(3671): n is a, c, g, or t
  misc_feature (3675)..(3676): n is a, c, g, or t
  misc_feature (3678)..(3679): n is a, c, g, or t
  misc_feature (3682)..(3683): n is a, c, g, or t
  misc_feature (3687)..(3687): n is a, c, g, or t
  misc_feature (3692)..(3692): n is a, c, g, or t
  misc_feature (3695)..(3695): n is a, c, g, or t
  misc_feature (3698)..(3699): n is a, c, g, or t
  misc_feature (3702)..(3704): n is a, c, g, or t
  misc_feature (3706)..(3706): n is a, c, g, or t
  misc_feature (3710)..(3710): n is a, c, g, or t
  misc_feature (3713)..(3715): n is a, c, g, or t
  misc_feature (3717)..(3717): n is a, c, g, or t
  misc_feature (3719)..(3719): n is a, c, g, or t
  misc_feature (3723)..(3723): n is a, c, g, or t
  misc_feature (3726)..(3727): n is a, c, g, or t
  misc_feature (3730)..(3730): n is a, c, g, or t
  misc_feature (3732)..(3732): n is a, c, g, or t
  misc_feature (3734)..(3734): n is a, c, g, or t
  misc_feature (3736)..(3737): n is a, c, g, or t
  misc_feature (3740)..(3740): n is a, c, g, or t
  misc_feature (3744)..(3744): n is a, c, g, or t
  misc_feature (3747)..(3747): n is a, c, g, or t
  misc_feature (3750)..(3751): n is a, c, g, or t
  misc_feature (3753)..(3753): n is a, c, g, or t
  misc_feature (3756)..(3756): n is a, c, g, or t
  misc_feature (3758)..(3758): n is a, c, g, or t
  misc_feature (3763)..(3763): n is a, c, g, or t
  misc_feature (3765)..(3765): n is a, c, g, or t
  misc_feature (3770)..(3771): n is a, c, g, or t
  misc_feature (3773)..(3777): n is a, c, g, or t
  misc_feature (3780)..(3781): n is a, c, g, or t
  misc_feature (3785)..(3786): n is a, c, g, or t
  misc_feature (3788)..(3789): n is a, c, g, or t
  misc_feature (3791)..(3791): n is a, c, g, or t
  misc_feature (3794)..(3794): n is a, c, g, or t
  misc_feature (3798)..(3798): n is a, c, g, or t
  misc_feature (3803)..(3803): n is a, c, g, or t
  misc_feature (3806)..(3807): n is a, c, g, or t
  misc_feature (3810)..(3810): n is a, c, g, or t
  misc_feature (3812)..(3812): n is a, c, g, or t
  misc_feature (3815)..(3816): n is a, c, g, or t
  misc_feature (3818)..(3819): n is a, c, g, or t
  misc_feature (3821)..(3821): n is a, c, g, or t
  misc_feature (3824)..(3826): n is a, c, g, or t
  misc_feature (3828)..(3828): n is a, c, g, or t
  misc_feature (3831)..(3831): n is a, c, g, or t
  misc_feature (3833)..(3834): n is a, c, g, or t
  misc_feature (3836)..(3838): n is a, c, g, or t
  misc_feature (3840)..(3840): n is a, c, g, or t
  misc_feature (3842)..(3843): n is a, c, g, or t
  misc_feature (3845)..(3846): n is a, c, g, or t
  misc_feature (3849)..(3849): n is a, c, g, or t
  misc_feature (3851)..(3852): n is a, c, g, or t
  misc_feature (3854)..(3855): n is a, c, g, or t
  misc_feature (3857)..(3858): n is a, c, g, or t
  misc_feature (3863)..(3864): n is a, c, g, or t
  misc_feature (3866)..(3867): n is a, c, g, or t
  misc_feature (3869)..(3870): n is a, c, g, or t
  misc_feature (3875)..(3875): n is a, c, g, or t
  misc_feature (3878)..(3878): n is a, c, g, or t
  misc_feature (3882)..(3882): n is a, c, g, or t
  misc_feature (3884)..(3885): n is a, c, g, or t
  misc_feature (3887)..(3888): n is a, c, g, or t
  misc_feature (3890)..(3891): n is a, c, g, or t
  misc_feature (3894)..(3900): n is a, c, g, or t
  misc_feature (3902)..(3902): n is a, c, g, or t
  misc_feature (3905)..(3906): n is a, c, g, or t
  misc_feature (3908)..(3909): n is a, c, g, or t
  misc_feature (3911)..(3912): n is a, c, g, or t
  misc_feature (3914)..(3914): n is a, c, g, or t
  misc_feature (3916)..(3921): n is a, c, g, or t
  misc_feature (3923)..(3924): n is a, c, g, or t
  misc_feature (3926)..(3927): n is a, c, g, or t
  misc_feature (3929)..(3931): n is a, c, g, or t
  misc_feature (3933)..(3936): n is a, c, g, or t
  misc_feature (3938)..(3940): n is a, c, g, or t
  misc_feature (3942)..(3942): n is a, c, g, or t
  misc_feature (3944)..(3944): n is a, c, g, or t
  misc_feature (3946)..(3948): n is a, c, g, or t
  misc_feature (3950)..(3951): n is a, c, g, or t
  misc_feature (3953)..(3954): n is a, c, g, or t
  misc_feature (3956)..(3957): n is a, c, g, or t
  misc_feature (3959)..(3962): n is a, c, g, or t
  misc_feature (3965)..(3966): n is a, c, g, or t
  misc_feature (3968)..(3969): n is a, c, g, or t
  misc_feature (3971)..(3971): n is a, c, g, or t
  misc_feature (3974)..(3975): n is a, c, g, or t
  misc_feature (3977)..(3978): n is a, c, g, or t
  misc_feature (3980)..(3981): n is a, c, g, or t
  misc_feature (3983)..(3983): n is a, c, g, or t
  misc_feature (3989)..(3990): n is a, c, g, or t
  misc_feature (3992)..(3992): n is a, c, g, or t
  misc_feature (3995)..(3995): n is a, c, g, or t
  misc_feature (3999)..(3999): n is a, c, g, or t
agccgcgccaaaaccgccgcccgcctgcctgcatacgccgcgcaactgcaagcnctgggctttccctgccagtatttgcacggcgacgaactgcaagaactggaaccggcgctcgcccgccaacacggnggcatncactaccagcgctcggcgcanatcntngacctngcngccctcggcncgnnnctcgcncaagcnctncgcgcgagcggnggcancatnnncgaacacagccgcatcaccgcngcccgccgcgaaaacagcggcttcagcctcaaagcggaaaatggcgacagccaccangccgaccgcctcatcctctgcgcnggtgcgcacagcaaggcgctggccgacagcctcaccggcctgcgtgtaccgctggataccgaacgnggctaccacctcatgctgccgcangaagccgcgcgcctgcgcctgcccntctccagcatngaccacagcttcgtcatgacaccgatgcngcacggcctgcgcctcgccggnacggtggaatacgcgggactcgaagcgccgccgaacatggcgcgcgcgcagaacctgcggccattggcggaaaaactgctgcaancnccgctggangcccgcgatgcccanccctggatgggcttccgcccgaccaccgccgacagcntgccggtcatcgaccgcgatggcgacctgctcctcgccttcggncancagcacctcggcctgacgcaagcggcgctcaccgcggaaatcctcagcgcgctttactnnggcgaaaccccgccnntnganctcaccccctaccgcctgcnccgttttgcctgaaacggcnncgcggatacggcacatttcacaaaattccacagcacaaaccccacaaccgcacccgcaacgcggcgaaatccggtttttttaacaaccctcactcaaatttccacaaaccacacaagccgcttataatgcccgccgttctcatcggggtgtcggcgctgccggctgagagttacccgcagaacctgatccggatcatgccggcggagggattgaggcattctctacctttgcggctggtcttctttcttgaaaacgaggtgcaaagtgttcaaaaaactcctgattcttctttctttcgccgccgcggccgccagtgccaagccggtgctcaccgtctatacctacagctctttcaacacccaatggggcgcgggtcccggtctgaaagccgcctttgaaaaagtctgcgactgcgaggtgaaatatgtcgcccttgatcacggcgtgatgattctgaaccgcctgcgccaagagggcgagcagaacggcgccgatgtcatcatcggcattgacaacaccctgatgcaaaccgcgctcgataccggcctgttcgcgccgagcggcgtggataccagcaagctgaaactgccggacggctggacggatccggtgttcgtcccgtatgactacggctggttcagcttcgtctacgacaagacccgcctgaaaaacccgccgcgcagcctgcacgagctggtggaaagccaagagccgtggacggtgatttattccgacccgcgcgtcagcacgccggggcaaggtttcatgctgtggatgcagaaggtgtttggcgatgacgcccccgccgcctgggaaaaactggcgaagaaaaccgtaaccgtcaccaagggctccagcgaagcctacagcctctttagcaaaggcgagagcgacatggcgctttattattcgacctcgcccgcctatcagttgatgaaggaaaacaaggacatttacgccgccgcgctgttngacgaagggcattatttgcaggtggaagtcgccgcgcgtacccgcaccagcaaacagccggagctggcgcagaaattcctcgagttcctcatcacgcccgctttccaggaaaacatcgccaccaccaactggntctatccggcgggcgatgtcacgctgccggaggcgttcgccaaactgccgcgtccgcagaagtcgttgcagttcaccccggacgaggtgcagaaaaaccgtccgcagtggattgagcaatggcagaaggcggtaagccaataagtcccgtggcgcgcaggggttgcccctgcgcgttcttttttaatctaaaggctcacacatgaatcccgtaccaaaacnnctgttcctcgcgcttgccctcgccgccgcaagcgcccacgccatcncctgcccngccccgntngaagtnccgnaaggcgaaggcatcgaanccnctnnccncgtctgcggcgcnntgggcgtcttnanccancacggcaaaaaaggcttctttgacccgnacancggcgngntngtcgtccccgcncantttgacgncgtgtncnncgantacgtcgccgataccctgacgccggtgangaaaggcgaacactgggcttacgtcgatacccaaggcaaggcgnnnaccgcctnggaatnngannaagtnnnncngttcnncnacnacgacanantcnncnncgnnngcaannncgngnncnnnnnnannannnnccnnnacgnngnaanngncgngcngnngnaanncnancncnngnacnnnnncnnncgnnngnnnnncngnnnnaacnncnncaccgtcgccnncnaancggncnnanncngcnncctngncgnnannngcannnncntcntnncncncgnntacgncnnngcnngcngnntnggcgcngncntnnnccccgncnnannnngcgncanntngggcnannncanncnncnngncnnnnncgtgcannccnncgannncnnngcagccnnngccntcnnccncnacnnnnngnncngccnnnncnnnnncnncnnngnngcnannannnncnncnnncnngcggnnnnnnncncnnnnnncnncnnccnngnnnnnnannncngcnnnnnnnnncngccnccncnnnnnnnnnnnnnngnnncnnnnnnncnnnnnnnnccnncncnnnnngcnnncnnnnncntnnnnnncnngnncnnnanncnnngcnnncnnnnnnncnnnnnncnnnnnctcnncgncnacnnncnnnncnnccccnncnncctcnccgnnntnntcnnnntccnccnnnnnnnnnncntnnnnnncncnnnnnnccncnnncncnncnncnnnnnnnnnntncncnncgnnnnnnncnannnnnccnncnnnnncnncntnnncnncnnnncnnncntnnncnncnncnnnnnnncnnnncnnngccnccnnnnnnnnnncnncgnnnnnntnnncnncnnnnncnnnnnnnncnncnncnnnncnnnnctcnncnncnncngcngcnnnnnngnnnncnncnncnnannnnnnnnnnnnnnnnnnnnnnnnnnnncnnncgnnnncnnccgnnncnnccnnnncgncnncnnnnnnnncnncnncnnccncnnnnncntcnncnncnnnnnnnccnncnncnnnnncctnaacancntccncgnncncnnccgcnncnnncncnnnnnccnnnncgncnnnnnnnnnnnccnngncgncnncntcctnnncnncnnnnnnnnnnnntnncnncnncnncnnctnnncgccgncnncntcnncnnnnncnncnnnnncntgnncnnnnncannngcnnccncnncctnngncgcgncannnncnccncnnnnnncntngncnnnnccgnngnnctnntcancctcnccntcnnccnnntnctcntcnnnancngccncgnnctncncntnngcngccnccnccnncncgncnacctncncgaanncnnnnncannctcnncnncnccntgcncggcntcnnccncnccnncnncntcnnncnccncnngnnncncnncnncgncnncnncnnccacnncnncnncctcntcntccncnncnncnnccnnnnnnncntcnncnncnncntnnnnnncnncnncnnncnnnngnnngncntnnncnncnncnncnnnngcnncnncnccnncnncnncntgcgcnncntcncccnc

SEQ ID NO: 1660 - DNA, 4000 bp, Escherichia coli
  misc_feature (2218)..(2218): n is a, c, g, or t
  misc_feature (3139)..(4000): n is a, c, g, or t
aagatagcgcagaaatcccctatgtgcgtttgtcacggaaccttgtcctcctgccaaaaaccaagtcagacactgtgaaaggcgtttttctctcgatagagacagaaaagcctcctgtttggtttgaacatatgatcgtttcagccaagacacttgatctggctgatcggttgttgactctgcttgaggatttcaaacggatagatacgatccagtcagatttggattcatcagctttgcgtcttttgtttttgcatcactggcggaaaatggcactcagggagtcaacttgggcgcatatttggctcaacaaagatagtccgattgctcgatgtcatatcggcgtaacaacgattctttcaacgttgccgaaatttggaatgcttcagaaagcgcattgaagggcaacactctgttaatcagagtggatgcatgataagagctttcaggtaagggtgtaagacggagcacgacatgaaccagcaaattattatgccaaaaaggccgtcggagacatgcgaagttgaagcgacaatcgcaattatcgcaggcaaatggaaacctatgatcctgtttaatctgcggctcggtgcgttgcggttttccgatataaaaagagccctgcccaaaacatcggaccgcatgctcattcggtcgctgcgggaattggaagaggacaatcttatcagtcgcgaagttttcaaagaggtccccgcgcgcgttgaatacgaactgacggtccgtggcaaaagccttctgccggtgcttgacgtcatgagcaaatgggccgccacagaacatgggattgcctgacgcgggcgaaatagccaaaactaaaacacattagccagcttttttgtcgacatggcgcaggttaatttgaccaatcccatgctgctaaggtgccccacaaatgggtacaccttaactttttgattgtgatgatatgtcagagaggtcttgtttgttcccggtctccaaaggtcacatgtcaatctgcataccaacggctatggggacgaccttatcaccgaacttttgttcaagcgcgttggtggcccgccaaccggtacaatgcccgggaaggataagatcaatgtcaaattgggcaaaatcttcgaccgtttgatcgatgattttttcgttcgcaccagacaggtgatatcctccgatcaggctgtggaatgggatatttccaaaatctttgcgcgcggcatgcatgacattgacaatcccggcatgcgaacaggcagaaaaaattacaggacctttgtttttaatattcacggcaagatagcgttcatccataatcagcggatcaggttcccattcttttccatcctctgagcgccgcatatgccccggaaaccccacctcatagggggtcacccgatcaatttctccgctgacaaagaacatatcgttaagaacattcatcggtttgtctgtgatcacaggtttcccgtttttggcctttatatcctcagggtttgggatttctttaattggcaacagatcttctccggggagcggcaatgccctttggcgaaacatgcccggatgaaggtatacgggtacttcttggttattgttttgttgcatgatcagatcaagcgccattggtaggccaccggcatgatcccaatgtccgtgtgacaacataatcccgtcaatttcaccaaatttcgcaccgaggcgagtcccgttatattcgaccgcaaattcaacggggccggcgtcaaacaatatggttttactttcctccccaatccacgcctttacaatcaaggcaagcccatgattggcgcaacattggcagctcccgcttagctgttccataccggcttttctcaggttgctccattcagaggtaaagttggcaggtgttgtcgacaaactgtcggtcttattatcgatcaagaccgttatctctattccatcaacttcacgaagtccgtccgtatccatcaccgtatccctttttctattactttctatctaatgataggtagataaatgagtatccaacagccgtcaacctcagaatttgatgaacgaaatgaaattgtgctggcctgcacgcatggaatattatggcttaaaccgagccaagtctatgtttgcatcgggttgaaacgttcatccacgcagtagcttaaaggaagcacctcagggctggtatttccgctatctggcagataaaccgcccgtccatttntgttaaaacgggtgaacgtttgtgccagttggcagagggcagaggccatatcggtccgggccacaaaatgccccaaacaatgatgtgcgccgccgccaaatccatgatgccgtttctgacgggcctgaatgtcaaattctcccacaggcccaagggctggatctttggcgcttgcatgcaccaagagatgcacagtggcacctttgggaaacggtactccgtcaaattcgaacgcttcggttgtttcccgcgtggcccaagtggtggtgggccatgcgcgaatagcttcttcgatggcgtttggaacaaggcgcagatcccgccgcaggtctgtccattgttccggataacgggcgaaaagtgcaatcaagaaccccaattggctccgcgtggtgtccacaccaccaaaaatcatgatgacgatgagatcgattaaatcttgatgtgaaatatcttttacgggatctttgaaggatattagccgccccaccaaatccttttgcgatctttgtgtctttgcgcgcgcgatcaattgctccgcaagagccattagccgatcgcaggcagcatttacctttgcctcatgggttttgtagtgcaaacccattgcaagccccaatgtgcttgcatcccctgcaactgtctgccaatcgctgcggggaagtccaagcagcgtgcaaattgcctgacccgaaaagggcatcgcgaattcagtctgaaattcacactgtctcttttccgcaagggataggcacagatcgcgcgcgatctcatcaaagctgggcacaagcgagagcacaaaatcttcgtccagcgcctttatcgctaaggcgcggattgttttgtgtttcggtccttccaaagaaattaaactgcgttgccaaaattctgcaaaactacctttggcattttgggatctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1661 - DNA, 4000 bp, Escherichia coli
  misc_feature (826)..(826): n is a, c, g, or t
  misc_feature (843)..(843): n is a, c, g, or t
  misc_feature (1230)..(1230): n is a, c, g, or t
  misc_feature (1670)..(1670): n is a, c, g, or t
  misc_feature (3863)..(3863): n is a, c, g, or t
tggcagctcttctctggtggaaaaccaataatgcagtacagtttccattgtttaagactgctaaacgctctatgtcatcgtgccattacaggcgaaataaattgaaattgatttatgatctatggccgtaacccttggggcaaaaatatcatttacgttctctgaaaatcaaacgtacttcgctcccgctatgattttagtgttaaaggtacactcatgagtaaatatgcaacggatttaggcgaaaatatcccttgggtaatagcaagcactttttgcggctttagcgtcgatgataaaactattcgtgccgcctacgatgacacaggcggtgaggttgacgactttaatgtgaaggcaccgtccaatccgcttttcgtaagtaacggcttcacggatggacggttacctcggtccgtcaagtacatgacccatcgcacattttaaaaagcggggggggaccgccctcgtctaatgtaggcgatcttgcgtctcaggttaaaaagatagacgtttctggcaatttgcttcacggtaatgtgaatggatcgaccgcagcccacataaaaatgctgcgtggcattgccatgaagtatccccgcagttcaaccgttcgtaaatgggtggcgacatgtatggtcgccaaatcggctaaagcgggcatacgtggaactaagttagttggggcggctattcccattggagcgttgggtatggcaacaaatgtcatcacaaatttagggcgtgcgggtgtgcggatgaattactgaaatgtcgttaacagggttgctatggagctgtactggcgtgcaaacgtcgaaatgtnactttcgggtgtcggtngtggaaaaattacaacaaaggtaaatggtccggctagtgcaatcatgtgtgagattttccgtcgccgtggccccaccgggttctttggtcaatgtgatgtcactaacattatttcggaatccggtggttggttcgctttgcgcgctaagttactttgatgtaataatccaacagtttctgcaagagaggtcgcaaagaagtattgcaaaccaagcgtatcatatggagagggcaaccagcggctgaacgcgtttctggcaacttgtcagaacgagaacgacttaaccgtgagtacgagatgttgacgctttttggcggcactcaggcgcctaaagttttgtgctacgaaaatattgcaggctcagtccgtctcgtccgaagttggtnagaaggttctacgctggatcaagtaccgcgctgcgaaagggctcagattatcgcaagattgcgcgatatgctcaggaaaattcatgaagctggctggattcacggtgatttgaagcctgagaacattatttctgcttcaactgggccggttttgattgactgggagcatgcagcacctattggggctgaggtaagacgactttccgcccgtgctgtgaccgtcggtatgacacaccctgacttgatttggggacgtggatctgttcggagaagatttgatttctatgccttagaccaaattgcagcagtatcgatcgattgtagttgttgactagcactccggtagttttgagatgccatgatcctgcatttcctggccgcctacagccggctctatcagacaaagctacttaacatcggacgagcaactttatagcgtnttgtaactaagaaacattcttcatttgttactttaaacttggcctggggtctccgatccatcctgccgaggatcggagaccaagacctatgggtcccggacaatagagtagccaacgacgtccagcctatcgtgttgccgaaactcaatttgcatcggatggttttgttcttccccatcgcaccacttaagttacttcattaaaatatctgataagggttgttgcctttagctccagtccaacaaccaaaatgcccatacttgggattctagttctcgtttttggagagtgtccacagagcgcatttaattgtagagatctaggcctgcggcgaccggtctcggagggctcaatgtatccgtcctatgccccacgctaggcacactgaattattatcatactttctgtctaggagttggctttggcattaataattaaaatttaaataaatgtattaaacgcgagatatacatgatggataaaatattttcacttgaaccgtatgaaatcatcaacagagaggctgtctttcggcattgcccaaatcaggcccttgcgcgttttctgccccatgttgctgttaagtcgttacagtcaggcgatgaattacaatacgccggtcagacagcgaagttcgtatatttaattgtttccggcacgtttgaagccgctagcgaaggcggtcaaaaagtcaacgtcaagtcaggttttttgggtcaagaggcggcgataggtatggatttaaatatcgttactgcggtagcgacgagtgggtctagcgttttagtcatcccaaaggctgcgatttgggaactgagtaagtaccctgaatttcaccaagacctactcaattcgtttacttcgttgtttggcagagaacctaaggctgtagaagacgaagaaaactctaatgacaaaaagagctactcaagtgatttgaggatcttttttggttggcttatggcgttactggtaccgctaagcatgattgcgggcgttgttgaattctcgagcatccccaataaagagtcattatatttggttgccatcctttccacatccatagttatgtggatatttcgcttactgccagattttgtaccggctcttttttcggttttaggcattgttttgtttggccttgcaccttccagtgtcgttttggcaggctttggctcgaaaaccttctttatggcgctgagtatttttggtctgtctgctgtaattgttgtctcaggcctcagttataggattttactcctactgttaaaaatcggccccgcaaacaagacctggtactatatgtgtctgtttttatctggctcattattaactcccatcgtcccaacaaccaatggccgtgtgtcaatcgtcaccccgtttatgaaggatcttttagcctcgtttgatgaaaagtcagccaaggcagaagcgccacgattgtctgcagcggtgctcggcgggaccagtttattatcagcgattttcctcagctctaagtctgtgaacttccttgtttttggtcttatgccgtttcaagaacaaacccgattccagtgggtggactggttcgtcgcagcttcagttagtggcgctgtattattggtgctgtattctttagccagttggttgatatttaaaaataaagaaagaccagcgattccaaaggctctggtctgtgatcagctcaaaattttaggacctccctgcgccagcgaatgggcaggtgttgctggtttgttagtacttttggttagcttcatgacagtggcgatccaccatattgaaattccttggatcgcattggctatattgtttagtttgttaatgtttgggttcttggataaacaagaatttttgacgcggattgactggaacttcttgatttttttgggctcgttagttggccttgtttcgtccatggaatatgtggggttagatgtgtggctaaccgaaaaactgtcatggcttaatcattatatggccaacgaattcggcatgtttattgtcttgctgtcggtatcaatttttttggttagattggcgatcccgatcaacgcgacggtggtcatctttgcaaccttattaatgccggctgccataaacatcggcataacaccctggattgtgggctttatcatcctgttgactgccgaaggttatatctggccctatcaagcctcatattattcncaattttgctcgttagccggtccaaaatctggtgccgacagcaaaaaagtaatcatattaaatgcgatgcaatatgcatttaagttggcggctatttatgcgtcaatcccgttttggcaatatttgggactgctctg

SEQ ID NO: 1662 - DNA, 4000 bp, Escherichia coli
  misc_feature (4)..(7): n is a, c, g, or t
  misc_feature (11)..(15): n is a, c, g, or t
  misc_feature (17)..(17): n is a, c, g, or t
  misc_feature (20)..(20): n is a, c, g, or t
  misc_feature (23)..(23): n is a, c, g, or t
  misc_feature (25)..(25): n is a, c, g, or t
  misc_feature (27)..(28): n is a, c, g, or t
  misc_feature (31)..(32): n is a, c, g, or t
  misc_feature (37)..(37): n is a, c, g, or t
  misc_feature (39)..(39): n is a, c, g, or t
  misc_feature (43)..(44): n is a, c, g, or t
  misc_feature (46)..(48): n is a, c, g, or t
  misc_feature (50)..(51): n is a, c, g, or t
  misc_feature (53)..(54): n is a, c, g, or t
  misc_feature (56)..(56): n is a, c, g, or t
  misc_feature (59)..(60): n is a, c, g, or t
  misc_feature (63)..(66): n is a, c, g, or t
  misc_feature (68)..(75): n is a, c, g, or t
  misc_feature (77)..(78): n is a, c, g, or t
  misc_feature (81)..(83): n is a, c, g, or t
  misc_feature (85)..(86): n is a, c, g, or t
  misc_feature (88)..(90): n is a, c, g, or t
  misc_feature (92)..(92): n is a, c, g, or t
  misc_feature (94)..(95): n is a, c, g, or t
  misc_feature (97)..(99): n is a, c, g, or t
  misc_feature (101)..(104): n is a, c, g, or t
  misc_feature (106)..(107): n is a, c, g, or t
  misc_feature (109)..(110): n is a, c, g, or t
  misc_feature (112)..(112): n is a, c, g, or t
  misc_feature (114)..(118): n is a, c, g, or t
  misc_feature (121)..(123): n is a, c, g, or t
  misc_feature (126)..(132): n is a, c, g, or t
  misc_feature (134)..(134): n is a, c, g, or t
  misc_feature (139)..(140): n is a, c, g, or t
  misc_feature (142)..(142): n is a, c, g, or t
  misc_feature (147)..(148): n is a, c, g, or t
  misc_feature (150)..(150): n is a, c, g, or t
  misc_feature (152)..(152): n is a, c, g, or t
  misc_feature (154)..(154): n is a, c, g, or t
  misc_feature (156)..(157): n is a, c, g, or t
  misc_feature (161)..(163): n is a, c, g, or t
  misc_feature (166)..(167): n is a, c, g, or t
  misc_feature (170)..(170): n is a, c, g, or t
  misc_feature (175)..(176): n is a, c, g, or t
  misc_feature (184)..(188): n is a, c, g, or t
  misc_feature (194)..(195): n is a, c, g, or t
  misc_feature (199)..(204): n is a, c, g, or t
  misc_feature (207)..(208): n is a, c, g, or t
  misc_feature (211)..(212): n is a, c, g, or t
  misc_feature (214)..(215): n is a, c, g, or t
  misc_feature (218)..(218): n is a, c, g, or t
  misc_feature (221)..(224): n is a, c, g, or t
  misc_feature (227)..(227): n is a, c, g, or t
  misc_feature (230)..(231): n is a, c, g, or t
  misc_feature (235)..(235): n is a, c, g, or t
  misc_feature (238)..(238): n is a, c, g, or t
  misc_feature (240)..(241): n is a, c, g, or t
  misc_feature (243)..(243): n is a, c, g, or t
  misc_feature (245)..(246): n is a, c, g, or t
  misc_feature (248)..(254): n is a, c, g, or t
  misc_feature (258)..(259): n is a, c, g, or t
  misc_feature (262)..(263): n is a, c, g, or t
  misc_feature (265)..(265): n is a, c, g, or t
  misc_feature (267)..(267): n is a, c, g, or t
  misc_feature (269)..(271): n is a, c, g, or t
  misc_feature (274)..(276): n is a, c, g, or t
  misc_feature (278)..(282): n is a, c, g, or t
  misc_feature (284)..(284): n is a, c, g, or t
  misc_feature (288)..(290): n is a, c, g, or t
  misc_feature (292)..(297): n is a, c, g, or t
  misc_feature (301)..(305): n is a, c, g, or t
  misc_feature (307)..(307): n is a, c, g, or t
  misc_feature (309)..(311): n is a, c, g, or t
  misc_feature (316)..(317): n is a, c, g, or t
  misc_feature (319)..(329): n is a, c, g, or t
  misc_feature (332)..(332): n is a, c, g, or t
  misc_feature (334)..(336): n is a, c, g, or t
  misc_feature (339)..(342): n is a, c, g, or t
  misc_feature (344)..(345): n is a, c, g, or t
  misc_feature (347)..(349): n is a, c, g, or t
  misc_feature (354)..(356): n is a, c, g, or t
  misc_feature (384)..(384): n is a, c, g, or t
  misc_feature (398)..(399): n is a, c, g, or t
  misc_feature (407)..(407): n is a, c, g, or t
  misc_feature (430)..(430): n is a, c, g, or t
  misc_feature (438)..(438): n is a, c, g, or t
  misc_feature (449)..(449): n is a, c, g, or t
  misc_feature (512)..(512): n is a, c, g, or t
  misc_feature (515)..(517): n is a, c, g, or t
  misc_feature (524)..(524): n is a, c, g, or t
  misc_feature (532)..(532): n is a, c, g, or t
  misc_feature (565)..(565): n is a, c, g, or t
  misc_feature (582)..(582): n is a, c, g, or t
  misc_feature (634)..(634): n is a, c, g, or t
  misc_feature (642)..(642): n is a, c, g, or t
  misc_feature (701)..(701): n is a, c, g, or t
  misc_feature (707)..(707): n is a, c, g, or t
  misc_feature (713)..(713): n is a, c, g, or t
  misc_feature (720)..(721): n is a, c, g, or t
  misc_feature (724)..(725): n is a, c, g, or t
  misc_feature (728)..(728): n is a, c, g, or t
  misc_feature (732)..(733): n is a, c, g, or t
  misc_feature (752)..(752): n is a, c, g, or t
  misc_feature (754)..(754): n is a, c, g, or t
  misc_feature (757)..(757): n is a, c, g, or t
  misc_feature (761)..(761): n is a, c, g, or t
  misc_feature (764)..(764): n is a, c, g, or t
  misc_feature (767)..(767): n is a, c, g, or t
  misc_feature (769)..(769): n is a, c, g, or t
  misc_feature (771)..(771): n is a, c, g, or t
  misc_feature (773)..(773): n is a, c, g, or t
  misc_feature (802)..(802): n is a, c, g, or t
  misc_feature (835)..(835): n is a, c, g, or t
  misc_feature (857)..(857): n is a, c, g, or t
  misc_feature (902)..(902): n is a, c, g, or t
  misc_feature (905)..(905): n is a, c, g, or t
  misc_feature (908)..(908): n is a, c, g, or t
  misc_feature (913)..(914): n is a, c, g, or t
  misc_feature (917)..(917): n is a, c, g, or t
  misc_feature (921)..(921): n is a, c, g, or t
  misc_feature (928)..(929): n is a, c, g, or t
  misc_feature (940)..(941): n is a, c, g, or t
  misc_feature (944)..(944): n is a, c, g, or t
  misc_feature (947)..(947): n is a, c, g, or t
  misc_feature (961)..(962): n is a, c, g, or t
  misc_feature (968)..(968): n is a, c, g, or t
  misc_feature (973)..(973): n is a, c, g, or t
  misc_feature (977)..(977): n is a, c, g, or t
  misc_feature (1025)..(1025): n is a, c, g, or t
  misc_feature (1031)..(1032): n is a, c, g, or t
  misc_feature (1037)..(1037): n is a, c, g, or t
  misc_feature (1039)..(1040): n is a, c, g, or t
  misc_feature (1043)..(1046): n is a, c, g, or t
  misc_feature (1058)..(1058): n is a, c, g, or t
  misc_feature (1069)..(1069): n is a, c, g, or t
  misc_feature (1075)..(1076): n is a, c, g, or t
  misc_feature (1377)..(1377): n is a, c, g, or t
  misc_feature (1990)..(1990): n is a, c, g, or t
  misc_feature (3753)..(3753): n is a, c, g, or t
  misc_feature (3882)..(3882): n is a, c, g, or t
cctnnnnttannnnngnaanttngncnnaannttttncntggnntnnntnnannantcnntgnnnntnnnnnnnncnntgnnnanngnnntnannannntnnnnanngnngntnnnnnttnnngtnnnnnnnanttttnnancgacnntnancntnncaannnatnnaanaaagnnatgaaaannnnnatgganntacnnnnnnaanntgnntnnaanaannnnttnaannaagntgncnntnanncnnnnnnnaagnnaannananannnaannnannnnncnaaannnannnnnnaatnnnnnangnnntttgnnannnnnnnnnnnacngnnnaannnntnnannnttttnnntttctttttcttcggatatatacaatgnttccaactattatnncaccaatnattgctaaaacaatgccagtgtntgatgtancctcagagctngcttctatctcggaaataggaacggttggaagttcagtttgtccttcaactacgagaaaactngtnnnatagatntcaggtcntaatgcttcatctgatgaggcaaagatcttcancgtatttgctccaacancaagctgtgaagtttctgcttctgttagtacaatttcagacaaattgttgtnaactggtntgatgcctgatgcagaagtttcgcctttaggatttgagatgaaataatggattgcagangagtcngttgtntgaactnnaannganagtnnttttttcaaatccacaacntntgnaatntcnacntnantnatttttggaaatttaatttgctcaaactntttccacttgccagcctcaaaaggatatcctantgaatcaaatgactttatggtnatggttcttgattcaggggaatagttatcgagataaaatggtccnttnctnattanngcntgtntgttttnntcaatccattnnatngcngcatcatagcgttnntcaaantattnccantcatgttgtgaattttgtaatgatggtggaatgtatcttgattctttnaattcnncaagntnntcnnnnattatttttgcntcgtttggaanaatcanngaaagccagtttacgctcttgctaattccgccagaacgtgaaaaagataccttaccatcaagaacagcctcttccgaagcagccacaatctcccaaggcatgctgctccaaggggctgcccacgaagctatttcagcttcatcaaaatgccaataatcaacataaacctcaatagtgtcatcatcaattggctttattccaattagcgtttttgcattttgcgcagcctgcggagaatatacagaatcatatgtaatatcaccttcgtgcttttcggaaccccattcaagtaaaaaatacngagagtacagtatgtcattcatgtccatcttttgttcatggtgccagttaccaagaataagatcataggtaaccttgcttgtagcctcttggttacttcccacttttttccatacttgagtatctatgtcccatgaaatcgcatcttcaggaactgtgatttttttgtcactactaaaattttcaacttgccaatttgtacgaattggaatcatcttcccagtaaatgggtgactaaaaactccaggatcataaaggtttagccatatttggttactgtatacatcactaaatccggcaactgggttccatgctccctgatagatttgtttgacacctataaccagtgaatcattgtcagattttgcgttaattggagtaaatctggttggaacacctgcgccaagagcgttgataattccatcaatatcatcattgacaacgtactggtctgtcttgctggcaagaaaaatcctaacagattcactgacaccttcctttgttgcttgtttaattaacgaagttctttcttcagcagatgcaaaatcactaacatagatttttttggttatcgagtctagatagtcatttttgtaattccagtaggtaagatngttatttccaggcatattagaaaaccaaggcgaatacatttgcgctagcccaactgaatcgtattttgcaaatcctgagctgccccacccctcagtgtaaagatgccatttttgatccgcaggatttgaaccataaacaacaacaaacgccttgttaagatctccaaagtctttgtttactttgaaaccaatattttcaaactctgatgataggatctcaccgattgattttcttacaggatcatcacttctaataaaaaatgtaatttcaatttgttttccattatgatgccagaaaccgtcaattttttcagcaccggctttttcaagttcctctgaaattattttattagctaatgctggattgtatttgaaatgaaatgattcaagttcgtcaatgatggaaagatagtcagccgcaaatattccataatttgaaatcatagtattgccataaccacctataagttcgttaacaattagatttctgtctacaagatagttcaatgcaaatcttaactcggtaattgaaaacgggttgaatgtttcagaaatagatgggttcaccagcatgctatatgagccaccagtagattcaaaaacttgaatgccttccctatctttttccgtctcaattctatctgaggaaacccgaaaatagtatatgtctagattgccgttccgaacttcttcaagtgctgtattttcgtccaaatactggatgaatttaacctcattcacgaacgttcctttttcagcaaatgatgtatgcagcataaatgatggtagtaatacgagtaatgctagtatagtaactagccaaaatttcatggcaaacatggtgtgttatcataatttaaggttcattaagctttaacaaaaaatctatgcagtgatttttttatggaaaacaaattgaaaactgcacttttggctataaagactggagtaccgattgaagaggcttcacgttctgttgattggaaagactttgagggtcttgtagctgagatactagaatcaaaaaactttgaagttttacgtaactttaggatgaagaagccaacaatggaaatagatgtagttggaatacgtcttggtacggcattacttattgattgtaaacattggaagaggatgagcaattctgcgcttgaaaaaattgttctaagacaaatagatcgtgtaaaacattatgtaaaaacaacaaatgaagctgtagctgccccagttattgtcacattatatcaagaggaaactaggtttatcaacagagtccctatcgttccaataatgcagttttcttcgtttattgatgaattttatggaaacttggaagagattagaaccatagaaaaatagacaataagaaaattccagtgcacaaaatcataaatccctgcgtcatcttcaaagaactatcgagtgccctagaaagatgctcaaaaattcctgagcccataatcctgactcttgcactattttctaaaatttcaaatttgcctgaagcgatatttttttccgcttgccttgcaatagacaggcaccagcttgctaatctttctgatttggtaatactaccaagctcatagtaaccatttctgtttcttactcccattgttgtggagtgtgtatcagaagtaaacatttcaactaattcacagccgttgttttttagatgtgttacaattttttcacgtacgccgttttccatattgttagcatctgcccaacacagaaagtatttcttttgatcaaaagcnaggcaaagcatacctataccaccaccagcaagatcactggtttgaatatccatagattgtgaatttgcatagccatattgcaatggatggttggtttttgtaatgagaatttcaagtacattttttgcngcagtgatcaaatcttgcgagtcttcttgcgatatctctcctcccatagcattgtgagtatcagcgatcaatatacgctggaaatttctgttttttgctatttgctcaatatctgtct

SEQ ID NO: 1663 - DNA, 4000 bp, Escherichia coli
  misc_feature (1)..(2): n is a, c, g, or t
  misc_feature (4)..(5): n is a, c, g, or t
  misc_feature (7)..(8): n is a, c, g, or t
  misc_feature (10)..(10): n is a, c, g, or t
  misc_feature (14)..(14): n is a, c, g, or t
  misc_feature (17)..(20): n is a, c, g, or t
  misc_feature (22)..(22): n is a, c, g, or t
  misc_feature (24)..(24): n is a, c, g, or t
  misc_feature (26)..(28): n is a, c, g, or t
  misc_feature (30)..(42): n is a, c, g, or t
  misc_feature (44)..(58): n is a, c, g, or t
  misc_feature (60)..(61): n is a, c, g, or t
  misc_feature (63)..(66): n is a, c, g, or t
  misc_feature (68)..(76): n is a, c, g, or t
  misc_feature (78)..(82): n is a, c, g, or t
  misc_feature (85)..(95): n is a, c, g, or t
  misc_feature (97)..(101): n is a, c, g, or t
  misc_feature (103)..(108): n is a, c, g, or t
  misc_feature (110)..(110): n is a, c, g, or t
  misc_feature (114)..(118): n is a, c, g, or t
  misc_feature (120)..(122): n is a, c, g, or t
  misc_feature (124)..(125): n is a, c, g, or t
  misc_feature (130)..(131): n is a, c, g, or t
  misc_feature (134)..(134): n is a, c, g, or t
  misc_feature (136)..(136): n is a, c, g, or t
  misc_feature (138)..(138): n is a, c, g, or t
  misc_feature (140)..(148): n is a, c, g, or t
  misc_feature (151)..(153): n is a, c, g, or t
  misc_feature (159)..(159): n is a, c, g, or t
  misc_feature (161)..(167): n is a, c, g, or t
  misc_feature (169)..(180): n is a, c, g, or t
  misc_feature (182)..(185): n is a, c, g, or t
  misc_feature (187)..(193): n is a, c, g, or t
  misc_feature (195)..(200): n is a, c, g, or t
  misc_feature (202)..(205): n is a, c, g, or t
  misc_feature (207)..(209): n is a, c, g, or t
  misc_feature (211)..(212): n is a, c, g, or t
  misc_feature (214)..(217): n is a, c, g, or t
  misc_feature (219)..(219): n is a, c, g, or t
  misc_feature (221)..(222): n is a, c, g, or t
  misc_feature (224)..(227): n is a, c, g, or t
  misc_feature (229)..(233): n is a, c, g, or t
  misc_feature (236)..(238): n is a, c, g, or t
  misc_feature (240)..(247): n is a, c, g, or t
  misc_feature (249)..(256): n is a, c, g, or t
  misc_feature (258)..(259): n is a, c, g, or t
  misc_feature (261)..(262): n is a, c, g, or t
  misc_feature (266)..(269): n is a, c, g, or t
  misc_feature (271)..(272): n is a, c, g, or t
  misc_feature (274)..(277): n is a, c, g, or t
  misc_feature (279)..(279): n is a, c, g, or t
  misc_feature (282)..(284): n is a, c, g, or t
  misc_feature (286)..(289): n is a, c, g, or t
  misc_feature (291)..(295): n is a, c, g, or t
  misc_feature (300)..(301): n is a, c, g, or t
  misc_feature (304)..(304): n is a, c, g, or t
  misc_feature (307)..(310): n is a, c, g, or t
  misc_feature (318)..(318): n is a, c, g, or t
  misc_feature (321)..(325): n is a, c, g, or t
  misc_feature (327)..(327): n is a, c, g, or t
  misc_feature (329)..(329): n is a, c, g, or t
  misc_feature (331)..(331): n is a, c, g, or t
  misc_feature (335)..(335): n is a, c, g, or t
  misc_feature (339)..(339): n is a, c, g, or t
  misc_feature (343)..(347): n is a, c, g, or t
  misc_feature (349)..(352): n is a, c, g, or t
  misc_feature (354)..(357): n is a, c, g, or t
  misc_feature (359)..(360): n is a, c, g, or t
  misc_feature (365)..(365): n is a, c, g, or t
  misc_feature (370)..(370): n is a, c, g, or t
  misc_feature (374)..(374): n is a, c, g, or t
  misc_feature (381)..(382): n is a, c, g, or t
  misc_feature (384)..(384): n is a, c, g, or t
  misc_feature (386)..(388): n is a, c, g, or t
  misc_feature (390)..(390): n is a, c, g, or t
  misc_feature (392)..(396): n is a, c, g, or t
  misc_feature (398)..(399): n is a, c, g, or t
  misc_feature (405)..(407): n is a, c, g, or t
  misc_feature (410)..(412): n is a, c, g, or t
  misc_feature (415)..(416): n is a, c, g, or t
  misc_feature (418)..(418): n is a, c, g, or t
  misc_feature (420)..(424): n is a, c, g, or t
  misc_feature (426)..(426): n is a, c, g, or t
  misc_feature (429)..(430): n is a, c, g, or t
  misc_feature (432)..(432): n is a, c, g, or t
  misc_feature (434)..(434): n is a, c, g, or t
  misc_feature (440)..(442): n is a, c, g, or t
  misc_feature (445)..(446): n is a, c, g, or t
  misc_feature (448)..(449): n is a, c, g, or t
  misc_feature (451)..(451): n is a, c, g, or t
  misc_feature (455)..(455): n is a, c, g, or t
  misc_feature (457)..(457): n is a, c, g, or t
  misc_feature (459)..(461): n is a, c, g, or t
  misc_feature (467)..(468): n is a, c, g, or t
  misc_feature (472)..(472): n is a, c, g, or t
  misc_feature (475)..(478): n is a, c, g, or t
  misc_feature (481)..(482): n is a, c, g, or t
  misc_feature (485)..(485): n is a, c, g, or t
  misc_feature (488)..(488): n is a, c, g, or t
  misc_feature (490)..(491): n is a, c, g, or t
  misc_feature (494)..(494): n is a, c, g, or t
  misc_feature (496)..(497): n is a, c, g, or t
  misc_feature (503)..(503): n is a, c, g, or t
  misc_feature (505)..(505): n is a, c, g, or t
  misc_feature (507)..(507): n is a, c, g, or t
  misc_feature (510)..(510): n is a, c, g, or t
  misc_feature (512)..(519): n is a, c, g, or t
  misc_feature (521)..(521): n is a, c, g, or t
  misc_feature (524)..(526): n is a, c, g, or t
  misc_feature (529)..(529): n is a, c, g, or t
  misc_feature (531)..(532): n is a, c, g, or t
  misc_feature (534)..(535): n is a, c, g, or t
  misc_feature (537)..(540): n is a, c, g, or t
  misc_feature (542)..(546): n is a, c, g, or t
  misc_feature (549)..(550): n is a, c, g, or t
  misc_feature (554)..(554): n is a, c, g, or t
  misc_feature (556)..(559): n is a, c, g, or t
  misc_feature (563)..(566): n is a, c, g, or t
  misc_feature (569)..(569): n is a, c, g, or t
  misc_feature (572)..(572): n is a, c, g, or t
  misc_feature (574)..(576): n is a, c, g, or t
  misc_feature (578)..(580): n is a, c, g, or t
  misc_feature (583)..(584): n is a, c, g, or t
  misc_feature (586)..(586): n is a, c, g, or t
  misc_feature (588)..(588): n is a, c, g, or t
  misc_feature (592)..(595): n is a, c, g, or t
  misc_feature (598)..(600): n is a, c, g, or t
  misc_feature (603)..(606): n is a, c, g, or t
  misc_feature (608)..(608): n is a, c, g, or t
  misc_feature (610)..(610): n is a, c, g, or t
  misc_feature (614)..(615): n is a, c, g, or t
  misc_feature (617)..(619): n is a, c, g, or t
  misc_feature (621)..(621): n is a, c, g, or t
  misc_feature (623)..(623): n is a, c, g, or t
  misc_feature (625)..(627): n is a, c, g, or t
  misc_feature (629)..(629): n is a, c, g, or t
  misc_feature (631)..(631): n is a, c, g, or t
  misc_feature (633)..(635): n is a, c, g, or t
  misc_feature (637)..(642): n is a, c, g, or t
  misc_feature (648)..(649): n is a, c, g, or t
  misc_feature (651)..(651): n is a, c, g, or t
  misc_feature (654)..(654): n is a, c, g, or t
  misc_feature (657)..(657): n is a, c, g, or t
  misc_feature (660)..(660): n is a, c, g, or t
  misc_feature (662)..(664): n is a, c, g, or t
  misc_feature (666)..(666): n is a, c, g, or t
  misc_feature (669)..(671): n is a, c, g, or t
  misc_feature (673)..(673): n is a, c, g, or t
  misc_feature (678)..(678): n is a, c, g, or t
  misc_feature (680)..(680): n is a, c, g, or t
  misc_feature (685)..(685): n is a, c, g, or t
  misc_feature (687)..(687): n is a, c, g, or t
  misc_feature (690)..(691): n is a, c, g, or t
  misc_feature (693)..(693): n is a, c, g, or t
  misc_feature (696)..(698): n is a, c, g, or t
  misc_feature (701)..(704): n is a, c, g, or t
  misc_feature (708)..(708): n is a, c, g, or t
  misc_feature (710)..(712): n is a, c, g, or t
  misc_feature (715)..(718): n is a, c, g, or t
  misc_feature (720)..(721): n is a, c, g, or t
  misc_feature (723)..(723): n is a, c, g, or t
  misc_feature (726)..(727): n is a, c, g, or t
  misc_feature (729)..(730): n is a, c, g, or t
  misc_feature (733)..(737): n is a, c, g, or t
  misc_feature (739)..(750): n is a, c, g, or t
  misc_feature (753)..(753): n is a, c, g, or t
  misc_feature (755)..(756): n is a, c, g, or t
  misc_feature (758)..(760): n is a, c, g, or t
  misc_feature (764)..(769): n is a, c, g, or t
  misc_feature (776)..(782): n is a, c, g, or t
  misc_feature (785)..(785): n is a, c, g, or t
  misc_feature (789)..(789): n is a, c, g, or t
  misc_feature (794)..(795): n is a, c, g, or t
  misc_feature (799)..(801): n is a, c, g, or t
  misc_feature (803)..(803): n is a, c, g, or t
  misc_feature (805)..(805): n is a, c, g, or t
  misc_feature (809)..(813): n is a, c, g, or t
  misc_feature (815)..(820): n is a, c, g, or t
  misc_feature (827)..(828): n is a, c, g, or t
  misc_feature (831)..(831): n is a, c, g, or t
  misc_feature (834)..(834): n is a, c, g, or t
  misc_feature (836)..(836): n is a, c, g, or t
  misc_feature (838)..(839): n is a, c, g, or t
  misc_feature (841)..(843): n is a, c, g, or t
  misc_feature (845)..(851): n is a, c, g, or t
  misc_feature (853)..(857): n is a, c, g, or t
  misc_feature (859)..(860): n is a, c, g, or t
  misc_feature (862)..(863): n is a, c, g, or t
  misc_feature (865)..(867): n is a, c, g, or t
  misc_feature (870)..(871): n is a, c, g, or t
  misc_feature (874)..(874): n is a, c, g, or t
  misc_feature (877)..(877): n is a, c, g, or t
  misc_feature (879)..(880): n is a, c, g, or t
  misc_feature (882)..(882): n is a, c, g, or t
  misc_feature (884)..(885): n is a, c, g, or t
  misc_feature (887)..(887): n is a, c, g, or t
  misc_feature (889)..(890): n is a, c, g, or t
  misc_feature (892)..(892): n is a, c, g, or t
  misc_feature (896)..(897): n is a, c, g, or t
  misc_feature (899)..(900): n is a, c, g, or t
  misc_feature (906)..(906): n is a, c, g, or t
  misc_feature (908)..(908): n is a, c, g, or t
  misc_feature (910)..(911): n is a, c, g, or t
  misc_feature (914)..(914): n is a, c, g, or t
  misc_feature (917)..(922): n is a, c, g, or t
  misc_feature (942)..(942): n is a, c, g, or t
  misc_feature (945)..(945): n is a, c, g, or t
  misc_feature (960)..(960): n is a, c, g, or t
  misc_feature (972)..(972): n is a, c, g, or t
  misc_feature (989)..(989): n is a, c, g, or t
  misc_feature (1035)..(1035): n is a, c, g, or t
  misc_feature (1049)..(1049): n is a, c, g, or t
  misc_feature (1056)..(1056): n is a, c, g, or t
  misc_feature (1080)..(1080): n is a, c, g, or t
  misc_feature (1082)..(1082): n is a, c, g, or t
  misc_feature (1128)..(1128): n is a, c, g, or t
  misc_feature (1131)..(1131): n is a, c, g, or t
  misc_feature (1137)..(1137): n is a, c, g, or t
  misc_feature (1254)..(1254): n is a, c, g, or t
  misc_feature (1333)..(1336): n is a, c, g, or t
  misc_feature (1338)..(1338): n is a, c, g, or t
  misc_feature (1340)..(1341): n is a, c, g, or t
  misc_feature (1343)..(1350): n is a, c, g, or t
  misc_feature (1352)..(1354): n is a, c, g, or t
  misc_feature (1356)..(1358): n is a, c, g, or t
  misc_feature (1360)..(1363): n is a, c, g, or t
  misc_feature (1365)..(1368): n is a, c, g, or t
  misc_feature (1370)..(1370): n is a, c, g, or t
  misc_feature (1372)..(1373): n is a, c, g, or t
  misc_feature (1375)..(1384): n is a, c, g, or t
  misc_feature (1420)..(1421): n is a, c, g, or t
  misc_feature (1424)..(1424): n is a, c, g, or t
  misc_feature (1427)..(1427): n is a, c, g, or t
  misc_feature (1451)..(1451): n is a, c, g, or t
nntnngnnantttngannnntngncnnncnnnnnnnnnnnnnannnnnnnnnnnnnnntnncnnnngnnnnnnnnncnnnnnggnnnnnnnnnnncnnnnnannnnnntnccgnnnnngnnntnncggtnncantngncnnnnnnnnnccnnncgcccncnnnnnnnannnnnnnnnnnngnnnncnnnnnnnannnnnnannnnannngnncnnnncnanncnnnntnnnnntcnnntnnnnnnnngnnnnnnnnanntnnagcnnnnanngnnnntnggnnngnnnngnnnnnagcgnncgnagnnnnaaatccgngtnnnnntngntntgcnaaanctgnnnnngnnnntnnnncnncgtcngcagntttngaatcgnncnannngngnnnnncnntgtggnnnccnnnatnngntnnnnntnggnnancnaagcgnnnttnngnngntacntntnnnaggganngatnccnnnnggnnacngcntnncgncnnggaagnananccngnnnnnnnngngcnnngtngnncnngnnnncnnnnngtnnatcngnnnnaccnnnngcnccngnnngnnnatnngngnatannnnggnnnccnnnncncngacnngnnncnanannncntntnnngnnnnnncgggannanagnggnagnannnanacnnncnttcgncnccganantcnnancgnnncgnnnngcangnnnacnnnngnncntgnngnnagnnnnncnnnnnnnnnnnngtngnncnnncccnnnnnnagaaacnnnnnnnccnggtncatcnngagnnngntnttcnnnnncnnnnnncccgcanngantgngncnngnnncnnnnnnngnnnnncnncnncnnnctnnccnacngnngnanngncnncnacgnnannctgatncngnnccnggnnnnnnggtttcatgcggcagcctcnagnggatagcgcttcacnccaaagaatganaaggccggagggttcanaggcgcggccgtgggattgtagaggtacgccgtccagatgcccgangcggggcagacganttcctcnattggaacgtcgagcgagccgcananacccgccccggagcccgtgacgtagagggacgccggcacgtaggtntgngacaantaattcccgaacgggtctttgatccacacgtacaggttcgagggagccgtaccgagcatcaccttgacaccccggcacacaaactccgcatcgttctgcatctgcaagatgatatcngcgatgagttgcccggccgcgatcgccgccccgagcgccgccacgttcgaggaattgaacgaatagtgaaaggtttctnnnngntnnannnnnnnngnnngnnnannnnannnngncnngnnnnnnnnnntcatgccgcaaccctccaccgcttgaagccttccanntangcntgaaagtagatattccccgtgccngagaagtcgcaaagctgaagatcggcgtagactgaatcggccgcgttgattctccaatccaggggcatcggggcaccgttgatgtacgtcgccacgtcaaagtaatcgtcatcgagcgagtagcccgagcccgtccgaaacttcgccagcaccgtgccagagttcaccgtcccatccgccgtaattgcaatgagccgtttcctacatcgaaactccgaggccatgtcgattggaattgtcgccgtcgcattcaaaggcccagccaggggaatagccgtaggccccggaatcccatttgccgggttcaccgagctatagacaaattcctcatcccggtagcccttcggtgtgcgaggccccacgccctgttgccaggccggcgccatgatgttttgagacggcccgccaaaaatgcggggaatctgtgccgcgatgtcggaagcggggcaaatggaagactggcccgatttcatccaatacttgtaagccccttcaaacaggatcgagagaggctgggccacggtgacgttcgtaacctgaagcgtgacttggattttagagcccggtggacactccagttctttcgtgaacaggtaacgataggagccatagcccgcgatctgcaaacagtcttgcaggttcgatatcagaaactttccattcggcaattgaatctgaacggaaaccgccgtagccgcggccgtgagcatcgagatcgcacgcaggcaccaggtcgcgtctccggtaatctctttcgtgaggctctgagtcgccgtcgccggagcgatgccgaagtattgctgaacaaggaagccctttgggatgtaaaccaccgcaaggcccgtaggcgcaaccggccggccgcacttgctcagaacgaaatcggcttgtgtcaggagttgaatgtccatcacgctacccgatatctacgattttcttgtgccgcagcatttccgccaggagcgccgctacgccgtcttgctgcaaactgacttcgcggcaggattcgcaccgttgcaccaccgtttcgaggctgtgagctacgaccttgttgatttccccttgctgcgcgatgtgtttttccaccgttactacgagttcgtgcaggctggaaactgcctcgtcgattttctgtgtcatgcgctcctcctgcttgttgagcgcgtccacattggaacgaaggtttgcaatgaccacgacgatagcgactatcgaagtgagcagggacacagaactgccgatgatgaccagaatgttcatgagcgcccctggaaaatgccgtcatgggtgtcgttttcattttcgattcgctaccgcataaaccataacaccaagcccggaggcaatcaagagcgccgccaagggattcgcccgcaattgctccaggaaagtaccagccgaaggcccgcacgccgtaccgggctgaagcgccggagccccgccccacggaacgccaggcgagcgatacgaggtttccgcaagcgattgctttctccgtctgcgccggtccatgagagcttgcgggcttgcctgaaccgccatttccggcgagacgttcatcggaaggatgatcggcgcatccgagaattgcgacgggtctgccgcattcgccccggattgcccttgcgccacggtagccggccccattgccgaggatcgagccttgacggccgcgggcgacagcgcttgagacatctggattgccaccgccagaggcaccgtggaatcgaggctaccggattgcccttgcgataccgtggaccgtgccatcagcaccgcttgagccgccacatcggcaggcgtcagggcttgagtcatctgcaaagccgacgcatacggcaccgtcgaatccatgccaggtgacgcacaccccgcgccctttttcatgagcccgagcgcgatcacttgacgcgcccggcgagcagcagggttgccagagccgcgccgtgtcgcttgcggaatcggagagccgggaggcatcagcatatcgtcacctttgaatgaaccaaaccacgcccgccagaaacgccgctccgagaatcagaagaaggtacggcgcgacgataattcccaacattcggaaaagatgccgccgcgccattcctcaattgtagaacgaagggcaacccagcggaagaattgcccctgttcgactccgcgcgccgtcagggacgcggagaaagcgaactactgaactgcgcgatcggtcaagcccttgatgttggcgaccagccagaggcccacgcccccggttgcgcccgatgccagggtggttgccgagacgccggccggcccggaaccggacgggaagtagatggtcaaggaccactgcatctgaggcgccaagtattttgcaaagttgttcatgcggttcaccgcatgaggattcgcaatccccagggtccagacgccggtttcggtttgggtggacatgccagtgaagccctgccccgagggctgaagctccaggtatccttcgacaaagatcttgtcgatgattttgaactcgaaatacgagtactggcagaacgtgagcatatccgccactg

SEQ ID NO: 1664 - DNA, 4000 bp, Escherichia coli
  misc_feature (72)..(72): n is a, c, g, or t
  misc_feature (104)..(104): n is a, c, g, or t
  misc_feature (108)..(108): n is a, c, g, or t
  misc_feature (496)..(496): n is a, c, g, or t
  misc_feature (782)..(782): n is a, c, g, or t
  misc_feature (1007)..(1007): n is a, c, g, or t
  misc_feature (1016)..(1016): n is a, c, g, or t
  misc_feature (1448)..(1448): n is a, c, g, or t
  misc_feature (1544)..(1544): n is a, c, g, or t
  misc_feature (1580)..(1580): n is a, c, g, or t
  misc_feature (1601)..(1601): n is a, c, g, or t
  misc_feature (1612)..(1612): n is a, c, g, or t
  misc_feature (1689)..(1689): n is a, c, g, or t
  misc_feature (1989)..(1989): n is a, c, g, or t
  misc_feature (2000)..(2000): n is a, c, g, or t
cgcctcgcggcgcggctcaatttgccgttcttcgattcggactgcgagatcgaggcggcggccggcgaaacngtcgaagaaatctttcgcaatcgcggcgaggnggtntttcgcgatggcgagcgccgtgtcatcacccgtctgctcgcgcaacctgctcatgttttggcgaccggcggcggcgccttcatggatcccgcgacccgcgccgaaattgcgcgccgcggcgtctccgtgtggctgcgcgccgatatcgacacgttgttgacgcgggtcgcgcgccgcagcaaccggcccctcctgaaacaggggaacccgcgcgccgtgctgacggaactcatcgagcgccgctacccgatctatgcggaggccgatattacggtcgacagtggtgacggcgcggcggatttgaccgcgagccgaaccatcgccgcgcttgccgcctgtccccgcgcgctgctgccgcccgaaccggatggcgagccatgaccgtttnggggaactccgagcgcctgcgcgtcgagctcggcgatcgcagctacgatatcgttattggccccggtctcatcgttcgcgccggggcggagatcctgccgctgatgcgccgccgtcaggccatcatcatcacggaccggatcgtcgcggcgcatcacctcagcccgctatgcgccagctttgatgagcatggcatcgcgcatcgggagatcgtcctgccggccggcgaaggaaccaaggacctcgcccatttcggcgggctggtcgacgatattctcgcctgcggnatcgagcgcggcacgatgctcgtcgcgcttggcggcggcgtggtcggcgacatcgccggtttcgccgcggcgacattgttgcgcggcatcgattttgtacagatcccgacgacgctgttggcacaggtcgatagctcggtcggcggcaagacggcgatcaacaccgctgccggcaagaacctgctcggcgccttctatcagccgcgccaggtgcttgccgacacngacacgctnacgacgctgccggcgcgagaattgcgcgccggctatgccgagatcgcgaaatacggactgatccgcgacgcggggttcttcgagtggctcgaagcgcagcgtaaggcagtctgcgacctcgagccgcacgcggtcacgcgcgcgatcctgacgagctgtcaaatgaaggcgacgatcgtcgccgccgacgaacgtgaggagggtgaccgcgctctgctcaatttcggccataccttcggccatgcgctggaagccgagaccgggttcagcgacgccttgctgcacggagaggcggttgggcttggcatggtcctggctttcgattttgctgtccgcctcgggatcgcgaccggacaggacgcctcccgcgtccgacgtcaccttgcggcggccgggcttccgaccaagctcgccgcgataggcctgtcgggnggcgccgcggccaaccgcctggtcgcgcatatgggcaaggacaaaaaggtgcgagacggccggatcaccttgatcctgccgcgccggatcggcgangcctttgtcatgcgcgatgcatcggctgacgctttncgcgaatttctggctagcgcnggttaggccangtttcgggggcgctcaattgagcgtcggttggagactggcggcggcgcggtccggacggatagccgccgcgcgatanaaatcgacgatatagacgcgaatcgccgcggtcaggcttgatgatacgcgttgccgatcgatctcggtgacgagctggttgacgttggtctgccgttgccgcgcgatctccagcaaggcctcccacatgaccggttcaagccgcacgctggtgcgatggccgcccacgacgatattgcgaatgaccagagatgatcgggcgggctcgcgcttccgaggcgcccggcgcggcaatgctcgtgccatgcggctactttaacggccgcttgggagattgcaacctctacgggtttaatgtagnttccgtacccncatacggtggtatgccttggttcaggatcgatcttcctcgggtattagggtggttaacgagagagcatggacgcgggaggccagctcctctttcagggcctcgtagacgaggcgctgacgggcgacgcggccgagcccgccaaatgtcgccgaggtgatcgtcaccgcgaaatgggtttccccctcggggcgggcgccggcatggccggcatgccgatgcgactcgtcgacgatgtccagtcgcgttggcgcaaaccgctccgtcagcttatcgcgaatcgtctcggcaacactcatcgcgtctctttgcgatcgccgctctgcaactctacggcggcggcaagaaagccggcgagatcgtcgacgatatagtggatgaacgcgctgtctgcgtcgctcttcgcccaatcgagatcgttgcgcatccaggccgtcgtcatgccgagttcggcggccggggcgagattgcgggcgatgtcctcgaccatcagcgcggtctcgggccgcaccgtgtggcgctgcaagagaagccggtagccggcgagcgctggcttcggttcgaaatcggccgcgacaatatcgatgatgccactgaacgcggggctgaggccgagatggtcgagcagccgttcggcgtgcctcaccgaaccgttggtgtggacaatcttgcggccgtgcagccggccgagcgccgcgacgagttcggggttggccggcacacaggccagatcgatctcatgcacaaaggcgagaaattcgtgcgggtcgatgttgtgcacacgcatcaagccattgagggtcgtcccatgctcgcggaaatagctgcgccgcaactccgccgcctcttcgggcgtcacctcgagccgatcgcaaatgtattcgttcatccggcgctgcacctggtcgaacaggcggcacgaggccggatacagcgtgttgtcgagatcaaaaatccaggtctcgatctcgccaagcgggcagcgctcttgtctggttgtatatgccatcgatgcgtccgaagggcctagccgcggcggatcagcgtgccggcgccttccgtgaacaattcgagcaggattgcatgcggcacgcgtccgtccaggatgacggcggcttcgacgccgccatcgaccgcgccgagacaggtctcgactttggggatcatgccgccggagactgtgccttccacgatgagccgccgggcttctgccgcggtcagctccgggatcaggcgcttttcgtcgtcgagcacgccggcgacatcggtcagcagcagaaaccgcttcgccttgaccgcggcggcgactgctccggcgaccgtatcggcattgatattgtacgtctcgccgcccgcaccgaccccgatcggcgcgatgaccgggatgatgtcggattgccgaaacgtcgccagcacgcggtcgtcgatgcgctccggctccccgacaaatcccagatcggctccgttgcgcgtcaatttgcgggcacggatcaggccgccatccttgccgctcaagcctaccgcgcaaccgccgacagcgttgatcgcggcgacgagttgcttgttgatcgtgccggcgagaaccatctcgacgacttccatcgtctcgccgtcggtaacccgcaatccgtccacaaaagtgcttttgatgccgaggcgttgcagcatctggccgatctgcggcccaccgccatgcacgacgatcggattgatcccgacctgcttcaagagaacgatgtcgcgggcgaacggatcgccatcctcaccattccccatcgcatgcccgccgtatttgacgaggatcgtctggccggcataacggcgcagatagggcagcgcctcggcgaggacagcggctttcaatgcggggttggcgatagtcgggttcaccatggcgggcgcattttatcgtgcccggccgctcgtcgccaccgcgcccgccgcaacatcgctgcgagactcggagggtagtgcaaaggcggcgagcgccgcgcgaagggcc

SEQ ID NO: 1665 - DNA, 4000 bp, Escherichia coli
  misc_feature (2)..(4): n is a, c, g, or t
  misc_feature (7)..(7): n is a, c, g, or t
  misc_feature (12)..(12): n is a, c, g, or t
  misc_feature (15)..(16): n is a, c, g, or t
  misc_feature (18)..(18): n is a, c, g, or t
  misc_feature (20)..(20): n is a, c, g, or t
  misc_feature (22)..(23): n is a, c, g, or t
  misc_feature (25)..(25): n is a, c, g, or t
  misc_feature (27)..(27): n is a, c, g, or t
  misc_feature (30)..(37): n is a, c, g, or t
  misc_feature (40)..(40): n is a, c, g, or t
  misc_feature (42)..(49): n is a, c, g, or t
  misc_feature (53)..(53): n is a, c, g, or t
  misc_feature (55)..(55): n is a, c, g, or t
  misc_feature (58)..(61): n is a, c, g, or t
  misc_feature (63)..(66): n is a, c, g, or t
  misc_feature (68)..(69): n is a, c, g, or t
  misc_feature (72)..(73): n is a, c, g, or t
  misc_feature (75)..(77): n is a, c, g, or t
  misc_feature (79)..(79): n is a, c, g, or t
  misc_feature (81)..(83): n is a, c, g, or t
  misc_feature (86)..(89): n is a, c, g, or t
  misc_feature (93)..(93): n is a, c, g, or t
  misc_feature (96)..(96): n is a, c, g, or t
  misc_feature (99)..(99): n is a, c, g, or t
  misc_feature (102)..(102): n is a, c, g, or t
  misc_feature (104)..(109): n is a, c, g, or t
  misc_feature (114)..(115): n is a, c, g, or t
  misc_feature (117)..(120): n is a, c, g, or t
  misc_feature (124)..(124): n is a, c, g, or t
  misc_feature (126)..(129): n is a, c, g, or t
  misc_feature (132)..(132): n is a, c, g, or t
  misc_feature (134)..(135): n is a, c, g, or t
  misc_feature (138)..(140): n is a, c, g, or t
  misc_feature (1990)..(1990): n is a, c, g, or t
  misc_feature (2337)..(2337): n is a, c, g, or t
  misc_feature (2841)..(2841): n is a, c, g, or t
  misc_feature (2947)..(2947): n is a, c, g, or t
  misc_feature (3062)..(3062): n is a, c, g, or t
  misc_feature (3279)..(3279): n is a, c, g, or t
  misc_feature (3430)..(3430): n is a, c, g, or t
gnnngcncgccngcnncngnanncncnccnnnnnnnnganannnnnnnngcgncngannnngnnnncnngcnncnnntngnnntcnnnntcgntgnggntgncnnnnnncgtgnncnnnncctncnnnncgntnncgnnnccggtgccggtgccggtctcgtgcaggtgcgccgtcataccagatccaccgtctgcaggtactcgggcacggcaaccgaccagcccagttcatggtcgatccgcgcgcgcagcgcatcggccgcctccggctcgccgtgggtcacgaaggttcggcgcggtgtttgcgtgaagccgcgcatccacgcgaggatctcgtcggcatcggcgtgggcggaaaggttgtcgagcgaggccacctcggcgcggatcggcacgtcctggccatggatgcggacggtggacgcgccgtgcacgatcgcggcgccacgggtgccgcccgcctggtagccggcgaacaggatggtgttgcgatggtcgggcgcgaatgacttgaggtggtgcaccacgcgtcctcccgtggccatgccactggcggagatgatgaccatcggtccacgaccggcgctgagcgccttggactcctcgaccttgttgacgatcttcgcggcatggcacatgccctcgcattcctcgggcgagagccggtgctcgtcgcgatgggcgtggtacagccgtgtggcatcgatggccatcgggctgtccaggtacacgggcaggtgctggtggatgcgcccttgcttcttgagctggtagatgccgtacatcaggctctgcgctcggccgacagcgaacgctgggatgaccacgacccctccacgggcggccgtcttgttgatgacagtctccagctgcgccagtgcgtcggacgcttcatgcttgcggttgccgtaggtggattccaccagcaggtagtcggcgccggggacctgcaccggcgggcgcagcaccgggtcgttgggccggccgatgtcgccggagaagagcacggatcgccggccgtcgttgaggtgcacgaaggccgagccgagcatgtgcccggaaggcgtcaaccgcgcggtgagtccgggcagcgcctcgaagtcctgagagaacggacgtggcgcgaacagcttcaggcagcgctcggcgtcctcacgggtgtacagcggcagcgcgggctggtgtttggagaaaccgtgccggttggcgaacttcgcctcttcctcctgcagatggccgctgtcggtgagcaggatcttgcacagctcgtgcgtcgcggacgtgcagtaaacccggccgcgaaagccttgtcgcgccagcagtggcaggtagccgctgtggtcgatgtgggcgtgggtgagcacgaccgcgtcgacggtcttgggcgcgaccggcagcggctcccagttgcgcaggcgcagctgcttgaatccctggaacaggccgcagtccaccagaatggtcgcgtcgccatggcgcagcaggtatttggaaccggtcacggtgccggtggcacccagaaattgaagttgcatggtaggtctccaaggatgttgtcgttcaaagaaggaccggccgatccggcaactcgttgccgtggtccgcgccccgcggaaagtgctgcaccagcaggtggctgacggccacgatgccttccagggctccggcctcgaagcgtccctgcgcaaactgggcttccatgcgctggcacacagccgaccacctttcggcaccgcaacaggcatggatgccgcgatcggccacgatctccacggcccggtcggccagcagcacgtagatcaggacgccgctgttgtgcgccgtatcccacacacccaggcgtgcgaacaggtccagcgcccgctcgcccggcgattggttgcgccacagtggcgatccgtccagcgcaccctcgaccacgaagcgcagctggcccccatgctggaactctcccgtgcggatggcctgctcgatcgcatccagcgcgcncggggggaaggcgcggcggactgcgcgatccgtggtcgcaaggtggcgaagaagtcgttgcatgttcatctcaccaccgtcctgacgcgccgccgccaccgaagccgccgccgccgccgcggaatccaccgccaccaccgcccaatcctccgcccggccagccgcctccccggtggcgcccgtgcatgccgccgtggccacccatgccgatgcccagcagcgtgacgaggaatcccgccagtccagccaccgcggccaccgcgaaggtgcccaccaacagccacgcagcggcacccagcacgccagccgtgaccagggagcctggaaggcggccgagggcgttgcgnagcactccgcccagcatcagggccgcgacgaacaggaagggccaggcctgcccgatgtcgttggtctgcccctgccgccgtgggtccgccgcaggcagggcctcgccatcgatcacccgcatgatctgttcggcgcctgcggcgatgccgccgtcgaaatcgccctggcgcaggcgcggcgtgatcacctcgtcgatgatgcgccgcgataccacgtcgctcagcgcaccctcgatgccgtatccgacttcgatgcgcacggtgcggtcgtccttggccaccaggagcaacgcgccgtcgtccaccttgcgacggccgagcttccattgctctaccacccgcagggcgtactgctcgacgggttcgggccgcgtcgagcggaccatcagcacggcgatctgcacgcccttgcgttgctcgaaggcccgaagctgcgcatccagcgcggcgacacgatcggcggcgagcgttcccgtgagatcggtgacgcgcgcctgcagcggnggaacggcgaccaactcctgcgcggacgcgaccgaaaggaacaggctcagcagcagccaggccagagcgtgggccagccgaagaggggccgccggagagagcaccnctgttctgggcgttctcatgtcaggggcgcgccgccggcgccgaggcgccgaaatcgacctgtggcggcgccgccatggccttctcgtcggcgaccgagaaattgggcttgacgncgtagctgaacagcttggccgtgatgttggtcgggaagctgcgcgtgagcacgttgtaatcctgcaccgccttcacgtagcgcccacgcgccacggtgatgcggttctccgtgccctcaagttgggcacgcaggtcttgaaaagcctggttcgccttgagttgcgggtagttctcgctcaccaccagcagccggctcagcgcgccggacagttcgcnctgtgccgcctggaacttctggaacgcctcggggttgttgacgagttccggcgtggcctggatcgaggtcgccttcgcgcgggcctcgaccacccgggtcagcgtctcctgctcgaagttggtctcgcccttgacggtcgcgacgatgttngggatcaggtcggcgcgccgctggtactggttcagcacctcggaccaggcggacttggtctgctcgtccagccgctggaagtcgttgtagccgcatccgctcagcgacagggcaagcgctgcgagcagggacatcaggatcagtctcatggttcggtttccgtggaagtgagaaaagtgcgggacggtgaagcgctcaccaggacggggttggctggccaccaatgccgcggaatgagcagcagcgcgagggtggcggccagtggaatcgacagccacgcaaaggtgctctgcatcacagcgccgaatagccatccggtggcggccgatcccagtgtttgtccgaggccggctgccgcggcgagccctcccatcgcgataccgagccgccgcgccgaggtgccggcagcgaggtaggccagggtggggagcacgagacccgtgcccgcagccgtgaaactcacgccgacgtacagccacatctcgctgccatggcgggccagcatcaggagcccggcgatgcccaggaccatgccgcaggccagtacgcggcgtgggtcggcgcgctcca

SEQ ID NO: 1666 - DNA, 4000 bp, Escherichia coli
  misc_feature (3191)..(3194): n is a, c, g, or t
  misc_feature (3283)..(3286): n is a, c, g, or t
  misc_feature (3301)..(3302): n is a, c, g, or t
  misc_feature (3310)..(3310): n is a, c, g, or t
  misc_feature (3313)..(3313): n is a, c, g, or t
  misc_feature (3347)..(3347): n is a, c, g, or t
  misc_feature (3357)..(3357): n is a, c, g, or t
  misc_feature (3361)..(3361): n is a, c, g, or t
  misc_feature (3366)..(3366): n is a, c, g, or t
  misc_feature (3431)..(3431): n is a, c, g, or t
  misc_feature (3575)..(3576): n is a, c, g, or t
  misc_feature (3667)..(3668): n is a, c, g, or t
  misc_feature (3670)..(3670): n is a, c, g, or t
  misc_feature (3674)..(3674): n is a, c, g, or t
  misc_feature (3684)..(3684): n is a, c, g, or t
  misc_feature (3687)..(3688): n is a, c, g, or t
  misc_feature (3690)..(3690): n is a, c, g, or t
  misc_feature (3692)..(3693): n is a, c, g, or t
  misc_feature (3695)..(3695): n is a, c, g, or t
  misc_feature (3697)..(3697): n is a, c, g, or t
  misc_feature (3700)..(3700): n is a, c, g, or t
  misc_feature (3703)..(3703): n is a, c, g, or t
  misc_feature (3707)..(3707): n is a, c, g, or t
  misc_feature (3716)..(3716): n is a, c, g, or t
  misc_feature (3718)..(3721): n is a, c, g, or t
  misc_feature (3723)..(3723): n is a, c, g, or t
  misc_feature (3727)..(3727): n is a, c, g, or t
  misc_feature (3729)..(3729): n is a, c, g, or t
  misc_feature (3731)..(3732): n is a, c, g, or t
  misc_feature (3828)..(3828): n is a, c, g, or t
  misc_feature (3833)..(3833): n is a, c, g, or t
  misc_feature (3838)..(3838): n is a, c, g, or t
  misc_feature (3840)..(3840): n is a, c, g, or t
  misc_feature (3846)..(3846): n is a, c, g, or t
  misc_feature (3848)..(3849): n is a, c, g, or t
  misc_feature (3855)..(3855): n is a, c, g, or t
  misc_feature (3858)..(3859): n is a, c, g, or t
  misc_feature (3862)..(3862): n is a, c, g, or t
  misc_feature (3864)..(3864): n is a, c, g, or t
  misc_feature (3871)..(3874): n is a, c, g, or t
  misc_feature (3876)..(3876): n is a, c, g, or t
  misc_feature (3881)..(3882): n is a, c, g, or t
  misc_feature (3888)..(3888): n is a, c, g, or t
  misc_feature (3890)..(3892): n is a, c, g, or t
  misc_feature (3898)..(3898): n is a, c, g, or t
  misc_feature (3900)..(3900): n is a, c, g, or t
  misc_feature (3904)..(3904): n is a, c, g, or t
  misc_feature (3908)..(3908): n is a, c, g, or t
  misc_feature (3914)..(3914): n is a, c, g, or t
  misc_feature (3918)..(3919): n is a, c, g, or t
  misc_feature (3921)..(3921): n is a, c, g, or t
  misc_feature (3924)..(3924): n is a, c, g, or t
  misc_feature (3928)..(3931): n is a, c, g, or t
  misc_feature (3937)..(3938): n is a, c, g, or t
  misc_feature (3940)..(3940): n is a, c, g, or t
  misc_feature (3943)..(3944): n is a, c, g, or t
  misc_feature (3951)..(3951): n is a, c, g, or t
  misc_feature (3954)..(3955): n is a, c, g, or t
  misc_feature (3957)..(3958): n is a, c, g, or t
  misc_feature (3960)..(3961): n is a, c, g, or t
  misc_feature (3965)..(3968): n is a, c, g, or t
  misc_feature (3972)..(3972): n is a, c, g, or t
  misc_feature (3974)..(3974): n is a, c, g, or t
  misc_feature (3978)..(3979): n is a, c, g, or t
  misc_feature (3982)..(3983): n is a, c, g, or t
  misc_feature (3985)..(3985): n is a, c, g, or t
  misc_feature (3987)..(3987): n is a, c, g, or t
  misc_feature (3989)..(3989): n is a, c, g, or t
gtggtatattaactcttgactttcaccaaggccaatatgctaaggtactattaacagaaaatgttacaggtattaatattcttaatgctcctgaagcgggtacagtaggtaatatgacagtagagctaacccaagatgctacaggcagcagaacttttgcaggtgcatttcttacagatagtggggcaggtgtaggagtttctgcggctgctaactctttaagccttatcgcgttactaactacagatggtggagcaacttatttaggtatgtcagcgggtaaggcgtacgcgcaatgatacctttatacacggtcaacgatgagtcaaaacgaataaccatatcagactctatacgtgcacaagacggcagccccatagtaaatgccttagtgcgtttatttcgtaatggtgtaccggttagtaaaacagtaaaaacagacgcagaaggtaaattctctttagattctttaccttatggtgactaccatgtagaggttttagctaataatattttagcccctgtagccaaaacatacatattagactcagctactttaacaggtactcctttggagggtgtacctacgtgggattcttgtgaaggtttaggcttaggtttaggctactcagaagacttatggcacgcacctcaatttgaatttggggttggcgctatttggcataccaatggagttatatccaatgattactatgaaaataagacctttgtatgtaatacaggtaccgacttctcagatgtactagcccaaagagctaatggaggcggagcattagctatgcctcatacccctattggaggtgaagctttccctgtaacgcctatacccgggtcatctatggatgactttacaatagtaaatccttttgattactatttggacacagatgggcattggtaccattatagatatggtaatagaataccagagtattgctacatgggagactatgcgtcccctcatgcaggtattaaagtccctgagggcttccattttgactcggcagtgggtccttttggaacatggtttattagtgatgtaaacaacctaacatactacagtgactggaatattacagacccaggagcttataacgctattcctttgtatctataccttctatatcatatagattctatggaccctactcccttgttctcctttgtatatggcaacctttcgaacattaaagatgatgttggaagcgcctgtattccactagagttccttttaggctcagagcactctatatcttcactagaattaagttcaggagaaggactaccctcttggatgtatacagggggaacttcagaaggtataccccctttagcttatactgaagagattgaagagaacatttataaatataaagctgtatctcaagactctaccataccgaagagcaagaagaagtatatactaaacgaattagtaattaagcctcgagttacccagctacaaacattcctaggtattacagaaacacaagctaaggctgctgtaatacgtgaaagtaatttaggtactttgacctctacgtatgataccccaacaggggcggatgtgtggaacatcagtgacgatatatcaaattatgcgttgactggtatggatactattccagtagtcccggatacttacttttcttcgggagagttcaacttcataataaataataataacttagcagtagtaggggcccataaagccgccccagaagtaaaagaagccattagtacttttggtacttcagagtgggatactgcaggaaagacttacttacagaacttaatgcgcttttcaaaagtgcctagacaggtggagagaaccagctacacgttgcccgaactagataatatactagacgatatatctcaaacattgaaccctacgcaggagttctcacccgagactttagctttcgtaaacaatgtagactcaaaaactgcagattacttaggagccgatacggttggagggcgctatatagctttagcggcatcaggtgcaggagcttatagtgactcagggaataagtatgaaagcaatccttattatggatttgctaaaggtgctttaatggcccaacttccgggactaggggatgactctagaaacctagttatggacacttcaccagatataactcattatcaacccagttcatactctatcaaagaaactttagtaattggagccttaggagtataccaattcgttactgagggagtaggagaactagtagatgcaataagccatagtgtaggacttccagggttaaatacgttattctcaaccaccttagctcctagaggtttaaatggtactcctgggctttccactagtaagccagtgaaagagcgggagtggtacgagaaggcttatgatgattgggaggaggaaagcctggggtatatgtgggcggtgtctacagggtggaaagccgaaaatacagatcaatttttccagtcgggagtcttagcagctcaatgggctaataagttagaccctagttacactttaccaactaccgcaatgaatcccccaacaccttctgtgggggataaagtgctccctgctatgttgtacaataaagccttcacaaattataaagagtacgaaggggcagaactttctactacttggaacgtagacaaagatagctgggacactgaagtatctttcatagacgagaatggagtagctcaaagtcattctgaggcaggagtgtacggagcgcctttagctctaaatgcagggaacactgagttagtagcaaatttagagcgctcaggttttgaaagaacttcttacgaagtcgatcccgcagatgtaactaaaatgatagctactttcgctaagcgcgctgatgtatatggagctagggaagacctaaaaatcttccaagtatctggcggtttggcagactttgatgctttctacaacagtaatttaactgctgaagagtacacagatgcacaacatgataacctactagcgagggcgagagatttagaatccgctagagagctttggttaacagctgaagagatcaacctgcgcacagaggaggcagactctgtaatacacctgcagacgctatggcatgaatattcagatgctcataaggtagcgaaggagtgtagagaagccgcaatggagcaannnncacgtgagtcgcgcacagaggaggcgttacacgctgccaaggttaaaagcataaaagcagcctacaatagagatcacccctccctgagnnnntcctgctcgggttannactacttnganggctatgggtgcccagaggagcttagtagacatnaggcctcagnagcnctgtnttgggagataatgaaagcctccatagacctttgtgatgatacgctttatagcgagaaacttgctntatgggggttaatagtagcagagatgtctagggtagatcttttacggcaggaaagctgggacacctccatggataaaaaagatgaagtaaatggggcttgggagcttttccaggattggaaagacgcagcaggagcgcatggtnntacttggggtactaaccctgacgggtccaaagggactagaaaaacgtttttcttttaaaggactatgagataaaattatggaagataaaannanaaanaagtaatggnaannanannancnaancanaaantaagcattncnnnnantacnancnntacatacgcaaaaccaaaacttagcagacaaacagctaataagtttaaaggggctatgggtacagttagtgatggagttaaccaagatacaggggngtggntagangntaaatntnnaaatcntgnngcntnaggaaannnngnattanntattantnnnaaaaanangaanaaantagaanaagnngnaanaggnnnntctagnncnatnnacgatanacnnanngnnactnnnnacantngcannggnnanangnaagaaatagta

SEQ ID NO: 1667 - DNA, 4000 bp, Escherichia coli
  misc_feature (2029)..(2029): n is a, c, g, or t
ggtaatcgacggtgtaagtttggtaatattcatttctcggatcattgactatacaaacataatcttcccaatccatgtctacatattctttagcaaattcctgcggcgtcatgctcccttttctgtgaaaatctccgtctttatcttcccattgccaatcgaattcttcaggaggtgtgcctagatggatgcataatattctccaaatatcttcaactctcttatctttgtgcactctagcttcctctttcgacccaccattatctaaaatttcacgtagttcacttgctccacttcttagaatgtctttcagtatagcattcatccatcttgtactcgatgatgagatactctctggataagcagtttttggcactaatccatgtttacggattaggttcattgccatattccattgcccgccatctccaattggatcacccagaagaaatccaatagttcggtcgtctagaggtctatctgctgtgtcaataattgcttcgaaaaaatgattacttctttcaaatttatcccagaaatgaatatgtgattgactaaattcaaagttcttgacatttaatttcttcattgtaccaggtctaaataaattcaaagttgcaaaaagccagcatcttccactacttttttgatttgtgactttccaatcatccaattttacagaaaatgacgaatcaatattttgtactaagtctctatttagcgcaacatctagtaggtttccatttgttactgcattctgtgcaactttcgctgctggatcatttgcaaaattatttctgaattcttttagttgtttatttgttactgattctcccatcggctcaccttcggtgaggctagtcgtacaatgacgactctaagtcattgcttctctatatctctgcagattcagcaaaacctgctgcaattagagtatccgccataagtgaagaaaagttagcaacctcacccgcagtaagctgaattgccgttccgtcttcgtcaataatagggtccattaaatcttgaataattctgattcttttcatatctgaattatttcttatatcttgttcttggtttattgaagttgatgagattgccccggtagctctttctggaaattcatccatttgacgaattctgtcttcctcatcaaattcgggatcatcccatatttcttgagatggttccggcgtaggtattacagaagagataatttcttcttctttatctaaatcactaaattccgttagtgcagcattacctcctaaacttggtttactcgctgacattggttttcctccatgtagcatattatcccaagaaacatcatttttgtatttctcaactaatctttcaacatttgtataataggctctttctgaagggtcatgacgttgccaatttaatggtgggactttatttccattctgatttccactcgacattttgagtaaatttgttaaaattgcatgttgagtgaacgcattcatcctcattcttgtcagatccgaaacagacgttcttgctactccaagtctgcgtgattgcaattgtgtttttgcattcattccttcattccttatagtttcagccaactcattttctaaatgacttagtaattgataaatcgaagaccagaaatttggtactgtaatttccacaggtacattttgactcgctttttgttgcctagtcaactcaaaaagggctttttcgacaacaattagttgttgcttagataatcttgatgaagcgacttcgtcaatcatgtgagcaacctgtgtaacggcagagagaggaaggccatgaatgattcctttgtttatcttctttcaagtctgttcatccgttggactcaataagaaaaaacctctcggagggtcgcaggtgtacccgagtggtcaaaggggtcgggctcaagttccgatgcgtagagcttcgcaggttcgaatcctgcctcctgcaccatcttcattttcgcgatctaataaattcttttagaaactcaattgtccctaaagtnccctttacttttgttagatgatcagcagcttcttccacgcctgggaattcattatttactgctacagaaaaaccacacatattgaacatagggatatcattcgacgcatctccaactgcgataactttctttggatcaatacctctttgttcaaatgcaactttaagtccactagctttattcaattctttttcagtaatgtgtactgcaaatcctgtaggtacaactcgtaaatcaggccattgtgaatcttttagagcatctttcattttttcataattttccgtatccaataagcaccattcggtctctctccagcgatttgtctcaattccttttggatctaatccctcaatttgagtagctagccattccgccgcatctcttgccctctttccatcagctaggcatcttatcggaaatcctgctttactatcccaaaccattcctccattctcacctattgcaaaccctgatatcgcaagcacttgttgtattggcgtaacatttggtagagttcttcctgaggctaaagatactgttatgcccatattctctatttctcttattaaagggattaaatcaggttggaaaccgtcaaaatctagtaatgtgccatctatatcaaagacaatcatttcccaatcatcgccttgaggcatcgtactcatatgcttgcgtagcagtcctatttcatcatctcatcgctcagacatcatctagtcatcttcaaggatggggctcttgtcgggtaactatggatgaggaagaatttcttcttcttgatgatgacgaggaagaaatcgccatttcttctaatgacaaatcaattaccgataaagtagcaaaacatacacctggggaaatattatctaatatatctaaaacagtcggggacagtatttcacagattcctttgaaactgaaagaatcatcaaatctgaagaagtcgatgaaagaaaaaaatgacaatataatctcatttgcacaaagtgcagataaaataatcgatgcagatttagttgttgatggaacttacaacatagaatggagaataggcggtatggattgcgcagattgtgcaatgaaggctagaaaagcagtcaatagattacccggcgtcaacaatgtgaaggtatcagttacagaaggtatcgttagaatggatttagatttagcaaaaggtagagtatctagagcaaactctgtattagagagtcttggacacaatcctgagattctctggcaatctgtgttcggccttacgcctagtcgtgcagctactaatcttggaatagaacgtaaaatgcttagaacagcattattagaagtcccaggaatgattaatgtaagatttgaagatggtaaaattgaattccaaagaattaccttcacttcaataaaaatgaaagatatctcaaatgaaaggctacaacaacttcttggtagtgatttaaaacttgaagaatctactaccttaaaacttagacctgaccaagtccaacttttatcagcagttctcacattgcctttacttgtaggtgtggtcgctattgatggattaaattcaatacctgattctttagctatactgttatgtttagtcggagtttcatttgcaggttttccaatgtttaaggctgccatagcaagtattcaaaatcgagtactcggttttcaggtattgacttcattggcagtaattggggcgatgttgatgcaagaatacccagaagcactcatagttacaggattggttgcctttgcagcacatctagaagaaagcgcccttgtaaaagccagaaatgctatgcaaggaggacttgatcgcttaccgaggttagctcgactttcatcttccactgaaactagttgctgtgatgatggaacttgtggacctactgttaagccagttgaagtcagttgttgcgatgatgatacatgcgattctaattttaaagtaattaaatc

SEQ ID NO: 1668 - DNA, 4000 bp, Escherichia coli
  misc_feature (1)..(3): n is a, c, g, or t
  misc_feature (5)..(8): n is a, c, g, or t
  misc_feature (11)..(11): n is a, c, g, or t
  misc_feature (13)..(14): n is a, c, g, or t
  misc_feature (16)..(17): n is a, c, g, or t
  misc_feature (20)..(23): n is a, c, g, or t
  misc_feature (25)..(26): n is a, c, g, or t
  misc_feature (32)..(33): n is a, c, g, or t
  misc_feature (35)..(35): n is a, c, g, or t
  misc_feature (37)..(37): n is a, c, g, or t
  misc_feature (39)..(39): n is a, c, g, or t
  misc_feature (41)..(42): n is a, c, g, or t
  misc_feature (44)..(44): n is a, c, g, or t
  misc_feature (47)..(47): n is a, c, g, or t
  misc_feature (49)..(50): n is a, c, g, or t
  misc_feature (52)..(52): n is a, c, g, or t
  misc_feature (54)..(54): n is a, c, g, or t
  misc_feature (56)..(58): n is a, c, g, or t
  misc_feature (60)..(60): n is a, c, g, or t
  misc_feature (63)..(63): n is a, c, g, or t
  misc_feature (65)..(66): n is a, c, g, or t
  misc_feature (71)..(71): n is a, c, g, or t
  misc_feature (74)..(74): n is a, c, g, or t
  misc_feature (76)..(79): n is a, c, g, or t
  misc_feature (83)..(84): n is a, c, g, or t
  misc_feature (90)..(90): n is a, c, g, or t
  misc_feature (92)..(92): n is a, c, g, or t
  misc_feature (94)..(96): n is a, c, g, or t
  misc_feature (98)..(98): n is a, c, g, or t
  misc_feature (100)..(100): n is a, c, g, or t
  misc_feature (102)..(102): n is a, c, g, or t
  misc_feature (105)..(105): n is a, c, g, or t
  misc_feature (107)..(108): n is a, c, g, or t
  misc_feature (110)..(111): n is a, c, g, or t
  misc_feature (114)..(116): n is a, c, g, or t
  misc_feature (120)..(120): n is a, c, g, or t
  misc_feature (122)..(125): n is a, c, g, or t
  misc_feature (127)..(127): n is a, c, g, or t
  misc_feature (129)..(129): n is a, c, g, or t
  misc_feature (131)..(131): n is a, c, g, or t
  misc_feature (134)..(135): n is a, c, g, or t
  misc_feature (142)..(144): n is a, c, g, or t
  misc_feature (146)..(147): n is a, c, g, or t
  misc_feature (150)..(150): n is a, c, g, or t
  misc_feature (155)..(158): n is a, c, g, or t
  misc_feature (160)..(161): n is a, c, g, or t
  misc_feature (163)..(163): n is a, c, g, or t
  misc_feature (166)..(166): n is a, c, g, or t
  misc_feature (171)..(171): n is a, c, g, or t
  misc_feature (173)..(174): n is a, c, g, or t
  misc_feature (182)..(182): n is a, c, g, or t
  misc_feature (184)..(184): n is a, c, g, or t
  misc_feature (187)..(188): n is a, c, g, or t
  misc_feature (191)..(191): n is a, c, g, or t
  misc_feature (194)..(194): n is a, c, g, or t
  misc_feature (196)..(196): n is a, c, g, or t
  misc_feature (198)..(198): n is a, c, g, or t
  misc_feature (200)..(204): n is a, c, g, or t
  misc_feature (206)..(206): n is a, c, g, or t
  misc_feature (209)..(212): n is a, c, g, or t
  misc_feature (220)..(221): n is a, c, g, or t
  misc_feature (223)..(224): n is a, c, g, or t
  misc_feature (228)..(228): n is a, c, g, or t
  misc_feature (230)..(232): n is a, c, g, or t
  misc_feature (238)..(239): n is a, c, g, or t
  misc_feature (242)..(242): n is a, c, g, or t
  misc_feature (244)..(244): n is a, c, g, or t
  misc_feature (246)..(246): n is a, c, g, or t
  misc_feature (249)..(251): n is a, c, g, or t
  misc_feature (257)..(260): n is a, c, g, or t
  misc_feature (267)..(267): n is a, c, g, or t
  misc_feature (269)..(269): n is a, c, g, or t
  misc_feature (271)..(273): n is a, c, g, or t
  misc_feature (277)..(279): n is a, c, g, or t
  misc_feature (286)..(288): n is a, c, g, or t
  misc_feature (290)..(292): n is a, c, g, or t
  misc_feature (295)..(296): n is a, c, g, or t
  misc_feature (299)..(300): n is a, c, g, or t
  misc_feature (303)..(304): n is a, c, g, or t
  misc_feature (307)..(307): n is a, c, g, or t
  misc_feature (309)..(309): n is a, c, g, or t
  misc_feature (311)..(311): n is a, c, g, or t
  misc_feature (315)..(318): n is a, c, g, or t
  misc_feature (320)..(320): n is a, c, g, or t
  misc_feature (323)..(324): n is a, c, g, or t
  misc_feature (327)..(327): n is a, c, g, or t
  misc_feature (329)..(332): n is a, c, g, or t
  misc_feature (334)..(334): n is a, c, g, or t
  misc_feature (340)..(341): n is a, c, g, or t
  misc_feature (343)..(344): n is a, c, g, or t
  misc_feature (346)..(347): n is a, c, g, or t
  misc_feature (349)..(349): n is a, c, g, or t
  misc_feature (351)..(352): n is a, c, g, or t
  misc_feature (355)..(355): n is a, c, g, or t
  misc_feature (359)..(359): n is a, c, g, or t
  misc_feature (363)..(363): n is a, c, g, or t
  misc_feature (365)..(365): n is a, c, g, or t
  misc_feature (367)..(368): n is a, c, g, or t
  misc_feature (373)..(374): n is a, c, g, or t
  misc_feature (377)..(377): n is a, c, g, or t
  misc_feature (379)..(379): n is a, c, g, or t
  misc_feature (381)..(381): n is a, c, g, or t
  misc_feature (383)..(383): n is a, c, g, or t
  misc_feature (385)..(385): n is a, c, g, or t
  misc_feature (388)..(388): n is a, c, g, or t
  misc_feature (391)..(391): n is a, c, g, or t
  misc_feature (394)..(394): n is a, c, g, or t
  misc_feature (403)..(405): n is a, c, g, or t
  misc_feature (407)..(408): n is a, c, g, or t
  misc_feature (410)..(410): n is a, c, g, or t
  misc_feature (412)..(412): n is a, c, g, or t
  misc_feature (415)..(416): n is a, c, g, or t
  misc_feature (418)..(418): n is a, c, g, or t
  misc_feature (420)..(421): n is a, c, g, or t
  misc_feature (424)..(425): n is a, c, g, or t
  misc_feature (428)..(428): n is a, c, g, or t
  misc_feature (430)..(431): n is a, c, g, or t
  misc_feature (434)..(435): n is a, c, g, or t
  misc_feature (437)..(437): n is a, c, g, or t
  misc_feature (439)..(440): n is a, c, g, or t
  misc_feature (444)..(449): n is a, c, g, or t
  misc_feature (451)..(456): n is a, c, g, or t
  misc_feature (461)..(462): n is a, c, g, or t
  misc_feature (464)..(464): n is a, c, g, or t
  misc_feature (467)..(467): n is a, c, g, or t
  misc_feature (469)..(470): n is a, c, g, or t
  misc_feature (473)..(474): n is a, c, g, or t
  misc_feature (479)..(479): n is a, c, g, or t
  misc_feature (481)..(482): n is a, c, g, or t
  misc_feature (485)..(485): n is a, c, g, or t
  misc_feature (487)..(488): n is a, c, g, or t
  misc_feature (490)..(493): n is a, c, g, or t
  misc_feature (495)..(495): n is a, c, g, or t
  misc_feature (497)..(498): n is a, c, g, or t
  misc_feature (500)..(500): n is a, c, g, or t
  misc_feature (502)..(503): n is a, c, g, or t
  misc_feature (506)..(507): n is a, c, g, or t
  misc_feature (512)..(512): n is a, c, g, or t
  misc_feature (514)..(515): n is a, c, g, or t
  misc_feature (518)..(520): n is a, c, g, or t
  misc_feature (524)..(527): n is a, c, g, or t
  misc_feature (529)..(529): n is a, c, g, or t
  misc_feature (533)..(534): n is a, c, g, or t
  misc_feature (536)..(536): n is a, c, g, or t
  misc_feature (538)..(541): n is a, c, g, or t
  misc_feature (543)..(545): n is a, c, g, or t
  misc_feature (547)..(548): n is a, c, g, or t
  misc_feature (550)..(550): n is a, c, g, or t
  misc_feature (554)..(556): n is a, c, g, or t
  misc_feature (559)..(559): n is a, c, g, or t
  misc_feature (561)..(561): n is a, c, g, or t
  misc_feature (565)..(566): n is a, c, g, or t
  misc_feature (568)..(568): n is a, c, g, or t
  misc_feature (572)..(572): n is a, c, g, or t
  misc_feature (574)..(575): n is a, c, g, or t
  misc_feature (577)..(577): n is a, c, g, or t
  misc_feature (580)..(581): n is a, c, g, or t
  misc_feature (583)..(584): n is a, c, g, or t
  misc_feature (586)..(586): n is a, c, g, or t
  misc_feature (589)..(592): n is a, c, g, or t
  misc_feature (595)..(596): n is a, c, g, or t
  misc_feature (600)..(603): n is a, c, g, or t
  misc_feature (605)..(606): n is a, c, g, or t
  misc_feature (608)..(613): n is a, c, g, or t
  misc_feature (616)..(618): n is a, c, g, or t
  misc_feature (620)..(621): n is a, c, g, or t
  misc_feature (623)..(624): n is a, c, g, or t
  misc_feature (629)..(629): n is a, c, g, or t
  misc_feature (631)..(632): n is a, c, g, or t
  misc_feature (634)..(634): n is a, c, g, or t
  misc_feature (638)..(643): n is a, c, g, or t
  misc_feature (645)..(645): n is a, c, g, or t
  misc_feature (647)..(648): n is a, c, g, or t
  misc_feature (651)..(651): n is a, c, g, or t
  misc_feature (653)..(653): n is a, c, g, or t
  misc_feature (657)..(657): n is a, c, g, or t
  misc_feature (660)..(660): n is a, c, g, or t
  misc_feature (667)..(668): n is a, c, g, or t
  misc_feature (670)..(670): n is a, c, g, or t
  misc_feature (672)..(672): n is a, c, g, or t
  misc_feature (677)..(677): n is a, c, g, or t
  misc_feature (679)..(683): n is a, c, g, or t
  misc_feature (685)..(686): n is a, c, g, or t
  misc_feature (689)..(692): n is a, c, g, or t
  misc_feature (694)..(697): n is a, c, g, or t
  misc_feature (700)..(700): n is a, c, g, or t
  misc_feature (703)..(704): n is a, c, g, or t
  misc_feature (706)..(706): n is a, c, g, or t
  misc_feature (713)..(713): n is a, c, g, or t
  misc_feature (715)..(715): n is a, c, g, or t
  misc_feature (717)..(719): n is a, c, g, or t
  misc_feature (721)..(721): n is a, c, g, or t
  misc_feature (723)..(724): n is a, c, g, or t
  misc_feature (728)..(730): n is a, c, g, or t
  misc_feature (734)..(734): n is a, c, g, or t
  misc_feature (736)..(740): n is a, c, g, or t
  misc_feature (742)..(742): n is a, c, g, or t
  misc_feature (744)..(747): n is a, c, g, or t
  misc_feature (751)..(752): n is a, c, g, or t
  misc_feature (758)..(759): n is a, c, g, or t
  misc_feature (761)..(761): n is a, c, g, or t
  misc_feature (763)..(764): n is a, c, g, or t
  misc_feature (766)..(769): n is a, c, g, or t
  misc_feature (773)..(773): n is a, c, g, or t
  misc_feature (776)..(777): n is a, c, g, or t
  misc_feature (779)..(779): n is a, c, g, or t
  misc_feature (781)..(785): n is a, c, g, or t
  misc_feature (789)..(789): n is a, c, g, or t
  misc_feature (792)..(792): n is a, c, g, or t
  misc_feature (794)..(796): n is a, c, g, or t
  misc_feature (800)..(800): n is a, c, g, or t
  misc_feature (802)..(802): n is a, c, g, or t
  misc_feature (804)..(804): n is a, c, g, or t
  misc_feature (807)..(808): n is a, c, g, or t
  misc_feature (810)..(810): n is a, c, g, or t
  misc_feature (814)..(815): n is a, c, g, or t
  misc_feature (819)..(821): n is a, c, g, or t
  misc_feature (824)..(825): n is a, c, g, or t
  misc_feature (827)..(827): n is a, c, g, or t
  misc_feature (829)..(829): n is a, c, g, or t
  misc_feature (832)..(837): n is a, c, g, or t
  misc_feature (839)..(839): n is a, c, g, or t
  misc_feature (841)..(844): n is a, c, g, or t
  misc_feature (847)..(847): n is a, c, g, or t
  misc_feature (849)..(851): n is a, c, g, or t
  misc_feature (856)..(860): n is a, c, g, or t
  misc_feature (862)..(864): n is a, c, g, or t
  misc_feature (869)..(871): n is a, c, g, or t
  misc_feature (873)..(873): n is a, c, g, or t
  misc_feature (876)..(876): n is a, c, g, or t
  misc_feature (878)..(880): n is a, c, g, or t
  misc_feature (886)..(886): n is a, c, g, or t
  misc_feature (888)..(891): n is a, c, g, or t
  misc_feature (893)..(894): n is a, c, g, or t
  misc_feature (896)..(897): n is a, c, g, or t
  misc_feature (899)..(900): n is a, c, g, or t
  misc_feature (904)..(905): n is a, c, g, or t
  misc_feature (908)..(910): n is a, c, g, or t
  misc_feature (913)..(914): n is a, c, g, or t
  misc_feature (918)..(918): n is a, c, g, or t
  misc_feature (921)..(923): n is a, c, g, or t
  misc_feature (925)..(926): n is a, c, g, or t
  misc_feature (929)..(929): n is a, c, g, or t
  misc_feature (937)..(937): n is a, c, g, or t
  misc_feature (939)..(939): n is a, c, g, or t
  misc_feature (941)..(941): n is a, c, g, or t
  misc_feature (943)..(943): n is a, c, g, or t
  misc_feature (946)..(950): n is a, c, g, or t
  misc_feature (956)..(956): n is a, c, g, or t
  misc_feature (959)..(960): n is a, c, g, or t
  misc_feature (963)..(964): n is a, c, g, or t
  misc_feature (966)..(967): n is a, c, g, or t
  misc_feature (970)..(970): n is a, c, g, or t
  misc_feature (972)..(972): n is a, c, g, or t
  misc_feature (974)..(975): n is a, c, g, or t
  misc_feature (977)..(978): n is a, c, g, or t
  misc_feature (980)..(980): n is a, c, g, or t
  misc_feature (982)..(985): n is a, c, g, or t
  misc_feature (990)..(990): n is a, c, g, or t
  misc_feature (992)..(993): n is a, c, g, or t
  misc_feature (1000)..(1001): n is a, c, g, or t
  misc_feature (1003)..(1003): n is a, c, g, or t
  misc_feature (1007)..(1011): n is a, c, g, or t
  misc_feature (1016)..(1017): n is a, c, g, or t
  misc_feature (1020)..(1021): n is a, c, g, or t
  misc_feature (1026)..(1027): n is a, c, g, or t
  misc_feature (1029)..(1030): n is a, c, g, or t
  misc_feature (1036)..(1036): n is a, c, g, or t
  misc_feature (1040)..(1040): n is a, c, g, or t
  misc_feature (1043)..(1043): n is a, c, g, or t
  misc_feature (1049)..(1049): n is a, c, g, or t
  misc_feature (1051)..(1052): n is a, c, g, or t
  misc_feature (1055)..(1055): n is a, c, g, or t
  misc_feature (1057)..(1058): n is a, c, g, or t
  misc_feature (1061)..(1062): n is a, c, g, or t
  misc_feature (1066)..(1067): n is a, c, g, or t
  misc_feature (1069)..(1075): n is a, c, g, or t
  misc_feature (1079)..(1080): n is a, c, g, or t
  misc_feature (1083)..(1090): n is a, c, g, or t
  misc_feature (1093)..(1093): n is a, c, g, or t
  misc_feature (1098)..(1098): n is a, c, g, or t
  misc_feature (1101)..(1101): n is a, c, g, or t
  misc_feature (1106)..(1107): n is a, c, g, or t
  misc_feature (1114)..(1116): n is a, c, g, or t
  misc_feature (1118)..(1118): n is a, c, g, or t
  misc_feature (1120)..(1121): n is a, c, g, or t
  misc_feature (1124)..(1127): n is a, c, g, or t
  misc_feature (1129)..(1133): n is a, c, g, or t
  misc_feature (1136)..(1142): n is a, c, g, or t
  misc_feature (1145)..(1146): n is a, c, g, or t
  misc_feature (1150)..(1151): n is a, c, g, or t
  misc_feature (1153)..(1155): n is a, c, g, or t
  misc_feature (1158)..(1158): n is a, c, g, or t
  misc_feature (1161)..(1161): n is a, c, g, or t
  misc_feature (1166)..(1166): n is a, c, g, or t
  misc_feature (1168)..(1168): n is a, c, g, or t
  misc_feature (1171)..(1173): n is a, c, g, or t
  misc_feature (1175)..(1176): n is a, c, g, or t
  misc_feature (1179)..(1179): n is a, c, g, or t
  misc_feature (1182)..(1183): n is a, c, g, or t
  misc_feature (1185)..(1188): n is a, c, g, or t
  misc_feature (1190)..(1190): n is a, c, g, or t
  misc_feature (1194)..(1196): n is a, c, g, or t
  misc_feature (1199)..(1200): n is a, c, g, or t
  misc_feature (1202)..(1202): n is a, c, g, or t
  misc_feature (1204)..(1204): n is a, c, g, or t
  misc_feature (1207)..(1214): n is a, c, g, or t
  misc_feature (1217)..(1218): n is a, c, g, or t
  misc_feature (1220)..(1222): n is a, c, g, or t
  misc_feature (1225)..(1225): n is a, c, g, or t
  misc_feature (1228)..(1228): n is a, c, g, or t
  misc_feature (1231)..(1233): n is a, c, g, or t
  misc_feature (1237)..(1238): n is a, c, g, or t
  misc_feature (1243)..(1244): n is a, c, g, or t
  misc_feature (1248)..(1248): n is a, c, g, or t
  misc_feature (1254)..(1258): n is a, c, g, or t
  misc_feature (1260)..(1262): n is a, c, g, or t
  misc_feature (1267)..(1267): n is a, c, g, or t
  misc_feature (1270)..(1270): n is a, c, g, or t
  misc_feature (1272)..(1275): n is a, c, g, or t
  misc_feature (1277)..(1278): n is a, c, g, or t
  misc_feature (1280)..(1280): n is a, c, g, or t
  misc_feature (1282)..(1283): n is a, c, g, or t
  misc_feature (1285)..(1285): n is a, c, g, or t
  misc_feature (1289)..(1291): n is a, c, g, or t
  misc_feature (1294)..(1294): n is a, c, g, or t
  misc_feature (1296)..(1307): n is a, c, g, or t
  misc_feature (1309)..(1309): n is a, c, g, or t
  misc_feature (1312)..(1312): n is a, c, g, or t
  misc_feature (1317)..(1317): n is a, c, g, or t
  misc_feature (1319)..(1319): n is a, c, g, or t
  misc_feature (1323)..(1323): n is a, c, g, or t
  misc_feature (1328)..(1329): n is a, c, g, or t
  misc_feature (1331)..(1331): n is a, c, g, or t
  misc_feature (1333)..(1334): n is a, c, g, or t
  misc_feature (1339)..(1342): n is a, c, g, or t
  misc_feature (1345)..(1346): n is a, c, g, or t
  misc_feature (1353)..(1355): n is a, c, g, or t
  misc_feature (1357)..(1358): n is a, c, g, or t
  misc_feature (1361)..(1362): n is a, c, g, or t
  misc_feature (1365)..(1365): n is a, c, g, or t
  misc_feature (1367)..(1367): n is a, c, g, or t
  misc_feature (1370)..(1371): n is a, c, g, or t
  misc_feature (1373)..(1375): n is a, c, g, or t
  misc_feature (1377)..(1377): n is a, c, g, or t
  misc_feature (1379)..(1383): n is a, c, g, or t
  misc_feature (1385)..(1385): n is a, c, g, or t
  misc_feature (1387)..(1387): n is a, c, g, or t
  misc_feature (1389)..(1394): n is a, c, g, or t
  misc_feature (1396)..(1397): n is a, c, g, or t
  misc_feature (1931)..(1931): n is a, c, g, or t
  misc_feature (1988)..(1988): n is a, c, g, or t
  misc_feature (1991)..(1991): n is a, c, g, or t
nnngnnnnccncnngnncgnnnngnncggcgnncngngngnngnggncnngngngnnngnctncnncgcgncgncnnnngcgnnccgaancncnnnancnanggngnnanngcnnncgcngnnnngncncnccnnggtgacnnngnncancgacnnnngnntnttncgcangnngtgatcgncnagnngtncgngngnannnnngncgnnnnggccgccnngnnccgncnnntcagcnnccncntngcnnncaccgnnnngcagggncngnnngtgnnngcggtcnnntnnnccnnggnncannccncngntcgnnnnancgnnctngnnnngngcgtcnncnncnnancnnccncgcncgancncnncatgnnggncncnancngcnagncgntcaccgcgnnncnngncnccnngngnntcnnggnannggnngngnnggcnnnnnngnnnnnnggcgnncnggncnncgnncgcancnncgngnncnnnncncnngncnncanncgcgncnncannnccgnnnncntcanngngnnnntnnncnngnaccnnntcncngtcnncnccgncnncnagnngnncnccnnnnagnnggannnnannannnnnngcnnngnngnntcggncnncnccgnnnnnncncnngcngnggcnctnggggcgnngncntgcgngnnnnncnncgnnnncnnnngcntcnncnccgcggncncnnngntnntgannnccgngnnnnngntnnnncacnnccagtnngncnnannnntcgngcnngnannnnncggngcncnnntcancnanccnngngcgnncgannncgnngngntgnnnnnngngnnnntcnannngcgcnnnnncnnnggcgnnngngtngnnncgatgntnnnngnncnngnnccgnnggnnnacnnccancgnnngnncgncatcgcgnangngnaannnnncgcgangannacnntnntcngngnncnngncnnnncgggngnngcggcgnngntctnnnnnccgcnnggnncggcnngnntttcgntggncgncatcgngnngancnncgnncgcnncnnnnnnnccgnnctnnnnnnnncgntcgcngantcggnnttgaagnnngngnngannnngnnnnnggnnnnnnncannacgnngnnngcnacncgggncncgnnngnnggnggnntnnnnangctnnncanngncngcnnnnnnnngcnngnnncgncgngcnnngcgnnccggnngttncgggcnnnnncnnncgcgngcntnnnnanngngnngntcannncgncnnnnnnnnnnnncncgngcatngncgcncgcgnncngnncgacnnnngcnngcggatnnngnncanngcntncgnncnnnancnnnnncngncnnnnnngnngcggcacctcccgtgccggtaaacgttgcgatcgtcggcccggccggggctggcaagaccacgctgttcaacgccctcacctccggtcgcggagccgacggggtgggcatggtcgacatcccggaccagcggctcacgcggctggccgaagcggtcaagcccgccaagacaactcccgcccaggttcgggtcgaagactcgcctcccggaagccgcgcccagcgcgtggccttcgcgcgccaggcagacgtcctgctgaaggtcgcccgctgcttcggccccgaccctgatcccgcggcagagctggaagagttcgcactcgacctcgtgctggctgacctggcctcggtcgaaaagcgtctcgagatagtggccaaggaggcgcgcgcaggcaagaaggatgcgcaggccgagaccgaggtcctgaccgccgccaagcagcatctcgacgcgggccagcagcttcgcaccctgcagctcgagcccgatcagcgcgcgatgctcgcggggatcttcccggtcaccctcaagccngccgtgtacgtcgccaacgcggcggaggagctgctgcctggcggggccgagcccgcngcnaaggtcaaaaggctggccgatgccgaaggcgctccgtcgatcacgctctcggcgcgcctcgaagccgagctggccgagctcgatccggcggagcaggccgagatgcgcgcgggctacggcatcgatgagtcgggcctgggccggatcgcgcgcgccgtttgggagacgggcggcctcatcacctacttcaccgccggcgagccggaggtcagggcatggccttgcgagcgcgactcccccgccccggtggcggcgtcgaagatccacacggatttcgagaagcacttcatccgggccgaggtcacctcagtcgatgagctggtcgccgccggatcgatggaggcgctccgcgccgccgggaagctccgggtcgagggtcgcgagtaccgggtcaaagacggcgacgtgatcttctttcgcatcggtcgctgaggcgttccgactcccaggtcaggagattccgtaggcctggcgcgtcgaccgccgcagcaggatgatcaggatcgggatcccaaccaggaccacagaccagccggccgcaacgatgaccgcggcgatccatccccagattcgcaaacgcctcagaccgtagtaggcggcgccatgcaggaccgcggccgcaagaccgaagaaaaagatcatcaccgactcgccggccagcgccgtgttgacgttgcccgtgaatccgccgttgacgagcgcctgggtgagcacgtcacgcccggccggcgccgccaggtacgcaccgaatcgggtcagctcgacgagccagaaaaccgcaccggcggcaaagaggtagggcagccaccgcatgggcccggtctgtgccggcggtctagattgcaagctcacgccctatcgtccgaaagatcttgacaacaactacattcggggttataactgcatccgggacacaacatatcgtagcccacgaaccagcaggttgagtcccacggcccaacgacaggcaggcggaacccttcccgagtcgcaccccacgacccagcaccagctcccctacccgcctgcctgttctattcacctccccaccctgtggggacgtcgccccagcctcctccccatttatggggaggtggcccgaagggccggaggggccagcggtctcggccgggtggggggattcaaatgcgattaacctcccaccctgtcgggcgggtggggcgaatcgagctggctttcacgccgtctagacttgcagatctatgagtcgcaagggcaagaagcgagccaaaggcaaattccgccagccgatgcgacctcccggcccgctcacgggcgtggcaacggcgggcgccggcgcccagacctcgaccgtgtcgaggagcgtgtcccaggcccgcgtcggcggtgaccaggcgatggtgcgggccgtcgagatgtcgctgggggggcgcaaccagatcatcaaaggacgcggcggcaggttcatcgtcgagtccgccgacccgtcgattccgctcgaccgcgtcccttacttcaccaaggacctggtgcggctcatggtggtcggcgcggccatgatcgtcctgctcgtcgtgggttcgctggccgtgcccctggtcgtcaagtaggcgtcacgatccctcgctccgtcgagtcgctggtggagcgaaccgtcgaggacaaccacggcaggcagcaggtggaaatcgaccgcacgtaagattcgcccgtgcgggtagtccttttcaccgggaaaggtggcgtcggcaagacatcggtcgccgcagccaccgccgtgcgctgcgccgccgccgggtatcggaccgtggtcatgagcaccgaccccgcgcactcgctgggtgactctttcgacctcgagctcggcagcgactcggtccaggtcggggacaaactgtgggcgcacgaggtttcatcgctccacgagatgcagcgtcactgggccaagctgcacgagtacgccgtcgaggtcttttccacacagggcctcgacgaggtgctcgccgacgaggtcgccaatcctccgg

SEQ ID NO: 1669 - DNA, 4000 bp, Escherichia coli
  misc_feature (3263)..(3263): n is a, c, g, or t
  misc_feature (3534)..(3534): n is a, c, g, or t
  misc_feature (3692)..(3692): n is a, c, g, or t
  misc_feature (3722)..(3722): n is a, c, g, or t
  misc_feature (3734)..(3734): n is a, c, g, or t
agtagggaatgcaacaaattcctcgaaaacgcagagcaacgtatagaaaaaatattaaagaatgaaaatggtgagtacgaacaaaaagaatttgtactcgactgaagaacacggtttgcggaaaatgtccgtaaatcaaaactaatatttcagagatgttctgtctccccttgatggaaagaaagaatgggggatgctgatttctgattactgaattctagaaaataaaactgcaagtctacgcaagctcaagcgaatgctgggttgtactgttcaatgtataagtaattgcgtcactacggttcctcttttcgatttctgatctgtaaatcaaatatttgtcagaacatcctgattttaaactcataaaaatcaggtaaaaaatgacagaagtagataataaaatcctcatcaatgtagaggatgacgaaaccagaattgcgttattacacggcaataagctggataacctttacattgaacaaactcaccgctcccaaaaagttggtaatatttattgcggtaaagtaataaaagtacaaccttcctttcaggcggccttcattgattacggtgaagaacgtcacggtttcctttccctttccgatataaacttccaagtctataaaccaaaccgtgaaggacgcggacggccttccatcacacaggttcttaaacccggacaaaaaattctggttcaggtaatcaaagatgaaattggacacaaaggcgcgtcaataaccacaaacatttctttggcgggacgttttcttgtttttatgccggacagtgaccgtggcggtgtttccaaaaaaattgaagatgaagaccaaagggcgcgtttgcgtcacttactgaaaggtctcggaagtgaaaattcatcagctattatccgtacggttggagttgatcgttcgctcactgaattgaaacgtgactacacgattttacgccgtacctggaatgaaatcaaagacgagtacgaagagcaatcaactcctggcatactctatcaggaagaagacgcgatgctgcggatgatccgtgattattacaatgacagtatttcggaagttgtgattgatgaaccggttgcatttcaacatgccttggagttttttaaaactcatatgccggcagaacaaaataagctgcagctttatcttggcgaaaaatctcttttttcaacttatgatattgaaggccaaattgaagtactgcatcacccgcaggttcctttgccttcaggcggttcattagtcatcatgcctacagaagcacttgtggcaattgacgtcaattccggaagatccactcaagaaagaaacgttgaggcaaccgcattacgtacaaaccttgaggctgcagatgaggttgcaagacagttacgtttaagaaacctcggtggtttgattgtggtggattttatcgatatggaaaactctaaaaaccgccttgctgtagaacaattaattgaagaagaaatgtcttcagacaaggccaagacttcgtttggcataatttccaaattcggattattggaattaagtcgtcagagaattgccagcagcttgtcacttaattctattgaaatcactttagcaaacaggattttacggaaaattcatgattccgcaattgaacaaaaagtgatgcagatttacctcagactgcctttaaaattggcgacccatctgctcaatattaagcgccaacgtttaactcaaatggaaatggattacggaatccgcatttcaataactcctgacactttacttggagttgaagaaattccggaaatggaagttactttaaaaggacagagcggaggagaaaccagaacatccgtgccaatttccgcctctgatatgcgtgacgataaaccaggcaggaaaaaaggtcgtgctaaaaaagagcaggacaaaaaagagtttgataaaaaggacgattccgtaactgttaaaagttctccggaaaagaaaacagcggatgaacagcccaaatcaacagaaactcctgcaaagactttgtcgaaaaatgaagagctaaagtccgctaaagagtccagagtgaaaactgaacttccggatacaactgctgaagcgaaaaagggcgctgaagagtcatcaataaaggatccgcaaaaaactgctgaatccgataaaaaaccagcaggaatcagcaaaccttcaacagcaaatgcagaaaaaacagaagaaacggtagtactttttaagagtagccatgaacctgtaaaagcagaggttgctccgaaaaagatcatctcaactcaggaaaaaattgctgagaacaaggacgaacctactgttgcaacttatacaagtgttcacctcgaagatcagcagaatttaacagagaaaactaaaattgttgctgctaataaaacagtaaaagaagatactgcagaaacaccaatgttcagtagtgttcatttaggcgatgcagaaaaaaaagccaaacagcttgctgcaaagcaggactctaaagctccgccagcagcagataaaacggcgccagttacggataaaaagtctgtaaaatctgctccgcgtaaatcaactgcaaaaaaacctatcgctaaaaagacggattccgcaaaagtctccacaaaagcacaacccaaaaaagcgaaagtagattctgctgaaaagtccgtagcaaagtctaaatcggctcaaagtaaagtctctgctgcaaaaaaggattctgcaaaatcagcaactcccaaacgtgcagaacaggataagaattctcctgtgaaatcgcttaaaaccacaaaacctaagccaaaggcaaaaattcctcagcagcagcaagataagcccgtaacaccggctgctgctcccaaagcagaagagtctgctgcttaaggccactgataaagtttccagggcataatgtcttaccaaaaccttccgtccatcacagagtgtgatgcgtttctcaaggaacaaaagctccctcacggcaaagcagtcagggagcaggtaaacatcgtgctggatcagctacgatcagaaatttccaaaaatccacacaaagctgtttcaactgccaatgcagaaatattggagcgtgttgcagcacaagtccgcaatcaatctcagaccacccaaagagtaatcaatgcaaccggcgttgtagtacataccaacttgggccgagctcctttgtccgaagttttgttacgcaaagtattacccggcatgagttcctactctaccttggaatttgatctcagnacgggaaaacgcggttcacgcgatgcaaaaatccgcaaactgctgcgtaccctttctggtgcagaagatgcgatggtggttaacaataatgccgctgctgtgtttttaatgctaaaggcattgaacggaaatgagactgaaaacaaaaaacctgaggttattgtctccagaggagagttagtagagattggtggatctttccggattcccgacataatgcgtgaagcaggagtcaaactggtagaagttggtacgactaaccgctgccganttgcggattatgaacaggccctcacagaaaacaccgctgctctgttaaaagtacatccttcaaattacgaaatccaaggctttacggaagaggtttccgttgaaaaaatggcacagctcgcacactcaaaaggtctgctttgctttcatgattggggnagcggcagtttttacaagttccgccaacgnggtttgagtgantattcaactgcggaacaggaactctcagccggtcctgatttgctggccttcagcggtgacaaattgctcggtggaatacaggctggtgtgttacttggaaaagctgaaaatattcaaaaactgcgtcagcatgctctctatcgagcattacgtttagacaaagtgacacttgctttgtttgaagcaactttggaagcatatcttgatttaaaaactctagcggaaaatgtgcctactgtcggactgcttgaactgacacgcgaaga

SEQ ID NO: 1670 - DNA, 4000 bp, Escherichia coli
  misc_feature (771)..(771): n is a, c, g, or t
  misc_feature (1286)..(1286): n is a, c, g, or t
  misc_feature (1570)..(1570): n is a, c, g, or t
  misc_feature (1985)..(1985): n is a, c, g, or t
cggacccgtcggggagccacgcgggggcgcgatcgttgccgaggttgaacgtgatgcgtcggggcgagccgccggcgaatggccgatccgacccggtctccgggccggcaaacggagcgctgtgttcgcagccggcgaaggcgagcgcaacaacgaccgcggcattcaagcggcgcatgggagcgggtggaattgtacgcggaaaccgcgtgacaagaaaccgggcgatcagtatcgttgcggcgtgatgccggaattgcgcgtcctccgaccgggcgacgaggtggtgctggacgcgttcctcgcccgccacgcggacagctcgatgttcctgcgatcgaatgcacgcgcagccgggctcgtcgaccgcggcgagcccggacaggggacctacgtggcggcgttcgagcacggtgtgatcgtgggcgtcgcggcgcattgttggaacggcatggtgctggtgcaggccccggggcacgtggcgaccctcgcccgcgaggcggtacggcgctccggtcgcacagtggccggcttctcaggtccgtgggaccaggtcgtcgccgcgcggcacgcgctggggctcagtgaagggaccacgcgcaaagacagccgcgaagacctctacaccctcgagctgcggcatctggtcgtccccgcggccctcgcggccggacaggtccgctgccgccaccccgaggacgcagagctcgatctcctcgtccagtggcggatcgccttctcggtcgaggcgctgggcgcgaccgccacccncgcgctggagacggcgtcccgggcggacgtgcggctgatccacgaccgcggggctgactggctgttgctcgacggcgcccggcctgtcgcgtactcggcgttcaacgcgatgctccccgaaatggtgcagatcggcggggtgtggacgccgaccccgctgcgggggcgcggctacgcccgcgctgtagtcgcggggtcgctgctcgcggctcgcgagcggggcgtcgagcgggccgtgctgttcgcggatcccctgaaccaggcggcccagcgcgcctacctgtcgctcggctttcggatcgtcggagactacgggctcgtgctgctggacacccgctaaccgagctacaccaccgccgatagattgagcagcgcgcgccacgcgcggaacacctcgcggtagtcctggtgcgtgaacgcgacggtccggcccgccgtccgggtggctccggggcacagttccgccatgtcggcgtggatcgtcagcgcgaaatccacttcgagggtggtcggcngggggagcacgaacggcgcgtgtttccgttgcagcgccgtcgtcacgccctcgcggatcatgcgacaggcgaccgccggcgcgacgctgcgtgccgcgtgacggctgaccgcctccttcacgacgaccacggccacgtggtcgcccagcagctcccgcgcctcggcggcgagggcggaatcgccgctcacgagcgccaccggcacgccagtgacaccggcgaaccctgcgttgatgccgagctcgccgaccggacggccgttgaggcgtacttcatggatacgntcggcgtaggtgtggtcgaggatcgcgttgcgcgtgccggcgcgggcgtggtagccgatgaacagcgccgcgtcgaagcccccgtctatcccctccaccatagagcgcggcttggggtcgcccgccaggagctcggccgcctgatgcagctcttcggcgagcaggttgcgcatgaaccagtggctgtcgttcaccacgatcttggtggcgccggccgccagcgcgccctcgatggcagcgttcgcttccgccgtcatgaggcgtcggaagcgggcgtactcggcggcgcaggcgggattggtcgggtcggtctgggactcatgcacgacgccggccacaccttccatgtcgacggagacgtaaacgcgcacgggtgactctcagggaaggtgtggtgtcgcgacaagggcagccnccaaagctaggatactttgcactataaagtacttgacgcagacgggtgcggcgagttatcttggcacgcatgacctccccccgtcccctgcacgaccgcgccctcgacaacctgcgctacatccggcagacgatggagcgcgccggatcgttcacggcggtgcccgggtggggccagatcgcggtcggggcgaccgcgctcgccgcggcggtggtcgcggcacgacagccgacgcccgaactgtggctggccacatggctgggtgaagccatcgtggcgctcacgatcggcgggtggacgatggtgcgcaaagcctacgccgtggacgaccctatcctctcgggaccaggtcggcgtttctggctcagcttcctcaccccgatggccgtgggcggactgctgacggtggtgctgtaccgtgccggtctgtggcacgcgctgcccgggacgtggctcctgctgtacggcacggggttcgtgacgggcggggcgttctcggtgcgggtcgtgccggtgatggggctgtgcttcatgatcctcggcgccgtggccctgctgggaccgcccgcctggggaagttggtgtttggcggccggattcggtggcctgcacgtcgcgttcggcgggatcatcgcacggaggtacggtggctaagccgggagcggtacgcaagacggatacggtcgcaccgccgctgcgcggcgaacgtgcgctgcgcgccgccgagctggaccggctgatccacgagcgggtgcgcctcggcatcgtgagtgcgctggcggtgaacgacgcgttgacgttcaacgacctgaaagcccttctcaggacaacggacggcaatctgagcgtgcatgcccgcaagctcgaggaggcgcagtacatcagctgcagcaaatcgttcgcgggccggatccccaagaccgagtaccgtttgacggcgctgggccggcgcgcgctggagcgctacctcgaccatatggaagccctgatccgcgcgacccgccagggctgagggaattttttttgaggcgagactttatgctgcaaagcacttcactccacgtcgcgatcattatggacggcaacgggcggtgggccgcccgccgcgggctcccccgcgccgccggccaccgcgcgggcgccgacgccgtccgccgggtggtggaagcggcccccggccagggcgtcgccgcgctcacgttgttcgccttctccgccgacaactggaaacgcccccccaccgaggtggcggcgctgatgcgactgttcgcccgtcacctgcgcaccgaaacggcccggctggtcgccaacggcgtccgcctcgaagtggtcggccggcgcgaccgcctccccgccccgctcgtcgccgccatccaggcggccgagctcgcgaccgccggcggaaccgcgctccggttccgcctcgccgtggattactcggcgcgcgccgcgatcccggccggccagctcctccccgacgtggatctcttgattcgcacgggcggcgagcagcgcctctccgactttctgctgtgggaatgcgcctatgcggagctgtacttcaccgaactcatgtggcccgatttcgcggcggccgacctggcggacgcgctgcgcgcgtttcacgcgcgccagcgacggttcggcgggctgccggaagcggccgccggatgagcgcgctcaccgagcgaacgaggctcggcctggaggtattggctacgggcgtcgtcctggggatcgcgggcgacgcgctgctgcgcgcgacaccgtgggggctgaacgcgttcctctgtactgtggcgcttgcggcggcggcggcgtggctggtgtatcgccggcggatcgcggtcgggcgcgacgcgccttggctcgcgatggccgccgtgctgctgggctcgaactttgcgatccgcgactctgacgcgctccgcgcgctcgatgcgatgggcctcgcgatcctgctcgcgctggccggtttcagcctgcgcggcgtcgcgctgcgcggccgcgacgcc

SEQ ID NO: 1671 - DNA, 4000 bp, Escherichia coli
  misc_feature (1951)..(1951): n is a, c, g, or t
cgcatcctgcagcgccgtgcgcacaaccttagtcgggtcaacaatacccgccttcaccaagtcagtgtaggtctccgtctgcgcatcaaagcccatggagccgcccttgccttcgagaagctttccggccacaacagcaccgtcaacgcccgcattctccgcaatctggcgaaccggcgcctgaagcgcacggcggacaatgtccacaccaacacgctggtcgtcatcttccaccttcagcttgtccagaaccttcgtggcatacagaagagcgcaaccaccgccagggacaatcccctcctcgacagccgcccgcgtcgcattcaacgcatcgtcaacacgatccttcttctccttaacctcgacttccgtcgcgccgccgatgttcagaacggcaacgccgcccgccaacttcgccaaacgctcctgaagcttctcacggtcatagtcggaagacgtctcttcaatctgagcccggatctggttgcaccggccctcgatgtccttcttcttgccggccccttcaaccaccgtcgtctcttccttggtgatcgacacccgtttggccgaacccatcatgtcgaggctgacgttctcaagcttgatgcccagatcttcgctgatcacctgaccagaggtcaggatcgcgatatcctcaagcatcgccttccggcggtcgccaaagcccggcgccttaacagcagcaaccttcagaccaccgcgcagcttgttcaccaccagcgtggccagagcctcgccttcgatatcctcggcaatgatcagcagcggacggcccgactgaaccacagcttccaataccggcagcatcgactgcaggctcgacagcttcttctcgtggatcaggatatacgggttgtccagatcgcaggtcatcttctccgcgttggtcacaaagtacggggacgtatacccacggtcgaactgcatgccttcaacaacatcaagctcgctgtgcaggctcttcgcctcttcaaccgtgatcacgccttcattaccaaccttcgacatggcgtcggcgatcatgttgccgacttccttgtcgccgttggccgagatcgtgccaacttgcgcaatctcttccgacgtggacacccgcttggactgcttggagagatcggcaacaaccgcctcaaccgcaaggtcaatgccccgcttcagatccatcgggttcatgcccgccgcaaccgccttcgcgccttcacgcacgatcgcctgcgccagaaccgtcgccgtcgtcgtgccgtcaccggcctcgtcattcgtcttgctggccacttcacgcaccatctgggcgcccatgttctcgaacttatcagaaagttcgatctccttggccaccgtaacgccgtccttcgtaatgcgcggcgcgccaaaagacttatccagaacaacgttccggcccttcggacccaacgtcaccttaaccgcgttcgcaagcgtatcgacgcccttaagcatcttcgcgcgagcatccgcctcaaactttacttccttcgctgccattgtcttgttctcctacaatgcagaattaaaaaaaatagccgccacccgatggggttaagcagctttcttcttggaaaccttggcttcgataatgccaagaatatctgattcacgaaggatcacgaggtcttgcccgtccaccttcacttcggtgccgccaaatttgctgaacagcacccggtcgccggctttcacatccagcggggtgactgaaccgtcatcggcgcgcgcaccggcgccggtggcgacaatttcaccttccgacggcttttctttggccgtgtccggaataatgataccaccagcggtcttttcttcctcgtcgatacggcggacgagaacgcgatcatgcaatggcttgaaacccattgtttcctccaaaatatctatccagaatccccgcttccccagctgtgcgcctcccccnggcgggcatttagcactcggagagcgagactgccagggtatttagtcccctcgttcagacagtcaaccccttcaaaacaaaaaacttttcagttttttcgggatttttttagcactctcaccggagtgctgataaatcattgaaaactataggcatttggaggaatcggggtatcttaaatgtgacgtgtcgactttagacggaggttttatatgcgaccgcgttccgttgaactgcagctcaagggctatcggctgacgacagccgagatattgtaccacctacccgattatccggaactcctgcaaagctttgtctggcaaaacttggatatggccccaagtttcccccgcctcaagaaattcctcgatcactgggaaacccagttggaaggcgctctgcattctgtccgtgtggccaacgcgcaactgatcaagccggccgagttccggatgatcgagaataactggacgttgcattaaggccggtcaatccagctcggtggtgagttccctgccctgccggtagcgccggtagagataaacgccgagcgcggcggagatgacaaagagcacgatgctaacggtgatgcgcagttcctgctccacgccgatgccgctgccgagcaacgcgaagattaccgtctgcgggatatagccgagcgccgagccggtcacaaaggccaccgcgcccgccccggagacgccggccaccagattggtgacaaagttgctgccgagcggcaacaggcggatcaacagcgtcgtggcgaacgtattctcccgcaggaaatcatcggcaatttgcagccgcctcggaaacttgcgggacacatagtcccgcccggcaaaccgggcgaagctgaaggaaatgacgcaacccatggccgtcgccaatagggcgagaccggagcccagcaccaaaccgaacgcatagccacccatgaaggaaatgatctggcgggggaatccgaccgagaccaaggccgccgagccgaacagatagatgagttccccacgcaagcccgcgccgcgcacattcgcgtcgatccactcttcggtaaaaagttcgccgaaccagcctttctgaaccgcgaacccgacccccaccagcacggcgatggtcaccaaaccgcgcagtacgtttttcaccagcggggtcatgcgtcttcggaatccccgccgatcttggaaacgtcggggttcaccgggcgcgtccgcagccaggccacaccgcggatatcctttagacccacccacagccggtcaaacgtgccgtagttggatttgccccgctcccgtggccgatggttaacttcgaccgagaccacccgtccgccgtggcggatcatcagggccggcaggaagcggtgcatgtgattaaacgcgggaaatgccaggaagtcttcgcgccggaacaccttgagcccgcaacccgtgtccggcgtcgcgtcccccaaatagcgggagcggacgccgttggcgatcttggacgacatgcgtttaacaaacgtgtccttgcggcccttgcgccagccggcgatcagcaccttaccgtccgacgaagcttgttcccggtatgcggctatcagattgggaatatcagcgggatcgttctgcccgtcaccgtcgagtgttgcgatcagcaacccacgagcgtgagagacgccagtatgcaccgcgacgctttggccactttggcgcgcgtgttggagggcgcggaagttaggaatttcccgggccacggcggccataacatcagatgacgtatcggcgctgccgtcattgacgaacaccatctcgaaggccggaccatctttcaacgcggcgacgatttcgtcgaccaacgggcggatgttatcggcctcgttatgcacgggcacaacgacactgaggtccggcggattgtgtttgtcactttggctcgacatggacttccggtaatacactccacgcccgagactgaaaagaaaattgcggcccggcgtaggcattgtctgattttgacctttgtggcacgctcacgccaatcatcgagcaaggagacact

SEQ ID NO: 1672 - DNA, 4000 bp, Escherichia coli
  misc_feature (1015)..(1015): n is a, c, g, or t
  misc_feature (1021)..(1021): n is a, c, g, or t
  misc_feature (1108)..(1108): n is a, c, g, or t
  misc_feature (1139)..(1139): n is a, c, g, or t
  misc_feature (1180)..(1180): n is a, c, g, or t
  misc_feature (1582)..(1582): n is a, c, g, or t
  misc_feature (1987)..(1987): n is a, c, g, or t
  misc_feature (3138)..(3138): n is a, c, g, or t
  misc_feature (3156)..(3156): n is a, c, g, or t
  misc_feature (3297)..(3297): n is a, c, g, or t
  misc_feature (3501)..(3501): n is a, c, g, or t
tacaattccagaaggtagtaatcttaatttataagttgttccatcaattactaatgtgtgtccagcattgtgtcctccttgaaaacgaataacaacatctgcttggtctgatagccagtcgactattttaccttttccttcatcaccccattgagatccaacaactacaacatttttcattatctaaattttttttctattgttactgaacttaaatggttgataggcccatgacctttaccgaatttaaggtttgaatttattgaattgtgtacatacttagttgcaagctcacaagatctctttaaggtttttccacatgaaaagaatgtagaaatagcagaagaaagggtgcaaccagtgccatgtgtattcctggttgtaattcttttattttttataatgaaaatttcatttttgtttacaaaaatatcttggacgattttagattctaaatgaccaccttttataaaaacattttttgctcctaattttattagtatgctggcagcaaaaatcatatcttcttttgttcttattttagttttagttaatatttcagcttctggaatatttggagtaattaggctaacttttttaattagttcattttttaataactgaattgccttatcatcaataagttttgcaccacctttagctaccataacaggatctaaaattatttttttaactttaataagatttaatgaatgaattactgattttattacttttgtagaatgcaacattccaatttttatggcatcaggtttaatgtcttttgaggtaaattctatttgatttgaaatttccttaggatcaattggtactattgattttacacctgttgtattttggattgtgacagctgttattgctgtcatggcatacgaacctaaagctgtgatagttttaatatcagcttggatgccagcaccaccagatgaatctgatccggcaataactaatattttagattttggtttcaatttatttaatttttcttaaaacnattttnaaacatttttgaagcaatttaatattatcactctctcccattactctgattttagactccgttcctgagcttctaactaatattctnccttgacctttaattaatttttctgctgatnttatagaatttttaatatcaatatttttaattatatttttntctttaacatcaatattttctaatatttgtggagttttcttaaaggtattaaaaaaactactagctttttttccttttcttaatgaaaataaaacttctaaagcaactaataagccatctccagtagttgcaaatttgcctagaataatatgcccagattgttcaccacctaaattaaaattatttttttgcattttctcttttacaaagcgatctcctacatttgatcttaagaattttatattatgtagtttaaaaaacttttctaatccatagttagacattaaagtgccaactacacctccttttaacattttttttcttttccatctcattgctattgcagcaattatttgatctccatcaattacaatacctttttcatcacacataataattctntcggcatctccatcaagtgaaattcctatatgtgctttatatttctttactgctaatctgattttatttggaaaagtagatccacaatttttattaatattaagaccattaggatttattccgattgaaaatactttagcacctaaagattttaataattcaggcccagccttgtatccagccccatttgcacaatcaatcactattcttaaacctcttaggttaaaatcttttggtaaattattttttaaaatttttatataatctttatttgcagtttctaacctttttacacgacccaatttttttggttttgataaagatttttcaattttttgatcaattaaagtttcaatttttttttcaattttatttgacagttttaacccatctggtccaaataantttaacccattgtcatgatatggattatgagatgctgtaatcataattcccatgttagctttcatactctttgtgagcattgctaagccattagttggaagtgggcctaatgtataaacgtgcataccagccgatgtaagtcctgatactaacgcaggttccaaactataccctgagagtctcgtatctttagcaattattgctatttgtttcttttttttttgagttttaaagtaagttcctgttgcaagaccaaatttaaaaaacatgtctccattaatatttttactattaacggcacctcttattccatctgttccaaaatatttttttgccattagtttttaattaattctttaaacacctttatactttgtcttaattcattcacatcatgaattcttagaatttgaactccttgcattattgcatacatggaagaagctactgttccacctaatctttccttgctatcattttttccagataaatccttaataaattttttcctagaaagtccaagtaatataggaaaaccaagagtatgaaaaatagaaacgcttctaattaaattcatattatgtttcaaattttttccaaaaccaattcctggatcaattacaatattattatgttttatacccatggatcttaaaaatttaatcttttgttcaaaaaaatcataaatatctaataattcatttttgtacttagggtttttttgcattttttctggtgtaccttgtgaatgttgaatgacaaatggagttttgctttttatcaataccttaactgttttagggtcataacttagacctgacacgtcatttataagtttaactcctaaatgaatccctttaatcataatttctgattttcttgtatctaatgatagtggaatttttttattaacatcttttaatatttcttttattctattccattcttcctttttacttacaggtttagatccaggtcttgttgattctccaccaacatcaataatatctgctccagatttaaataaattctttgcatgagatattccttttttctttttattaaatttacccccatcagaaaaactatctggtgttaaatttaatatacccattatattaggtattttattaaaatttaaacttgaaaantttttattttttttaacnatagtcttgagatctttattaattttttttttcagtagtttgggtaatttttttatatctttaagatcaatttttttgatagaagttcgtgtaagaatttcaatttgtccaaaagaaattttcttattaccatttagtggnagattttttttttttctaactaattcaattgaaaattgaccataagcaaaattacacgctcttgtgtaatattttttcatttagtattaatgaactattttcggcttaagacccattgaacttaaagctgaacctttatcttcatcttcaacttttaaatcctctttattgcttggatatatatttttatttatcaggttttcnatttcttcacctgtaagtgtttcatatgttaagagagctttagctaatttatgtagatcgtcaattttttcagttaaaactgttcttgctctttcataacctttatctacaatttttctaatttctgagtctactttctttgaggtttcttcagacatattttgagttctcgcaacagaccttcctaaaaatacctcttcttcattcgaaccataggcaactggtcccaactctttactaaggcctgcttgcattaccatagctcttgctctttgagttgcttgttcaatatcactagatgcaccagttgtaactttatcttctccaaatatgatttcttctgctactcttccacccatagctatagctaattgagcatgaagctgttctcttgtttgagatagctgatctctctcaggtagttgcataaccattcctaaagcacgacctctcggaatgattgttgccttatgaattggatgagccgcatcctcattaa

SEQ ID NO: 1673 - DNA, 4000 bp, Escherichia coli
  misc_feature (405)..(405): n is a, c, g, or t
  misc_feature (2046)..(2046): n is a, c, g, or t
  misc_feature (3218)..(3218): n is a, c, g, or t
  misc_feature (3236)..(3236): n is a, c, g, or t
  misc_feature (3626)..(3626): n is a, c, g, or t
  misc_feature (3629)..(3629): n is a, c, g, or t
  misc_feature (3632)..(3632): n is a, c, g, or t
  misc_feature (3780)..(3780): n is a, c, g, or t
  misc_feature (3824)..(3824): n is a, c, g, or t
  misc_feature (3854)..(3854): n is a, c, g, or t
  misc_feature (3863)..(3863): n is a, c, g, or t
  misc_feature (3866)..(3866): n is a, c, g, or t
  misc_feature (3869)..(3869): n is a, c, g, or t
  misc_feature (3878)..(3878): n is a, c, g, or t
  misc_feature (3909)..(3912): n is a, c, g, or t
  misc_feature (3915)..(3923): n is a, c, g, or t
  misc_feature (3927)..(3930): n is a, c, g, or t
  misc_feature (3932)..(3933): n is a, c, g, or t
  misc_feature (3936)..(3936): n is a, c, g, or t
  misc_feature (3938)..(3941): n is a, c, g, or t
  misc_feature (3943)..(3943): n is a, c, g, or t
  misc_feature (3945)..(3948): n is a, c, g, or t
  misc_feature (3950)..(3950): n is a, c, g, or t
  misc_feature (3952)..(3954): n is a, c, g, or t
  misc_feature (3956)..(3958): n is a, c, g, or t
  misc_feature (3960)..(3960): n is a, c, g, or t
  misc_feature (3962)..(3964): n is a, c, g, or t
  misc_feature (3966)..(3968): n is a, c, g, or t
  misc_feature (3970)..(3975): n is a, c, g, or t
  misc_feature (3977)..(3982): n is a, c, g, or t
  misc_feature (3986)..(3988): n is a, c, g, or t
  misc_feature (3990)..(3990): n is a, c, g, or t
  misc_feature (3992)..(3993): n is a, c, g, or t
  misc_feature (3995)..(3995): n is a, c, g, or t
  misc_feature (3998)..(4000): n is a, c, g, or t
aagctggcaatcagcagaaattctgcagcgactcgatgataacgatgtacccagtgcgccgctgctaacgcgcatggagttgctcgaccatcagcagatcaaagcaaacgctacggtggaacggatgacctacgagggttttggtgaggttcgccaggcaatgccagcagcacgatttgatttaacgccggctagcatctccggtccagcgccacaactgggcgagcacagccgggaaatattattgaggcttggctatgaaaaagaagccttagacgagttgttggcgagcaaggcagtcattgccaatgacaacaatgaatagccgaaacagataacttaaatattcacaaaaaagagggagagttcagtatgaaaccagtttgtctgatcatgggagcaggngcaggtatcggcggcaccactggcaagcgttttgccgacgaaggctaccacgctgtgttgtgtcgaaggagtgacaaagaaggcctcgacaacatggtcgcagagattgaaagcgccgggggttctgctaccggctttatcctgaatgcgacggaagaaaacaccattgaggacacgattgccgaggtcgaaaagaatattggtccgatagaagttgttgtgttcaatctcggtgctcagattggtgatcggccgttggcggcgacaacctacaaaatgtttgagctgggttggcgaatggcgacttttgggctttttcgcgtcgcatcggttgtatgccctctgatggctgagcgaggcaagggggccattctggtgacatcggcaacctctgcaatgcgcggtaatcgagggcagcattcccatgctgctgcgatgggtggcagaagaatgttgtgtcagacactcaatgcagaatttggcccccagggcgtgcatgtagcgcacatcgtggttgatggagccgttgatgcgccagatacgcttggcaaaatgctcggcgaagagcggtttcagcagttacgcgagacccgaggtggagaccttgacgggttgttgttgcctgaagaaattgcggatacttattaccacttggcgcaccagcatcgttctgcttggtcctttgagcttgatcttagaaccttctcagacaccgcctggtggaatcactcataactgcgacggtttcgtctcaggtcttccgtaatattgagcgcaaggcctgcgacgatcaacatcatcgccagcaatttccaccagggcatcgcttcatccagccatagccaggaagtcgtcataccgaagacaggcacgagcagcgcccagggcgcgacgctcgcggcagggtatcggtttaacagaatattccaaatcccataaccaatcagcatgttgccaatgctttgccaaagtaccgtcgcccatgcaaaccatgaggcattagccatgctactgactacctctgacaaaccagtttggtaaattgccaaaaatgcgaggggaggaatcgagcacagcgacgaccatgcaaggaacgcaaatgcatccacttcgccgacgtgtttcaccacgatgttaccacttgcccagctcaacgcggcaatcaatacaatggtcacgccaagcgctgttgttacttcgttcgtatttaaaaaaaccacaagcagacccagaaaggcgatagtcatcgcaactagctgaagtcggctaacagattctttgaggttcaaaactgtcagcaggaccgtaaagaaaacttgtagctggattagcagggatgcaacgccgggcgtgatgtcttcttgcattgcccaaaacagtaatccgaattgtccaacgccgatgagtagtccgtagccgacgatatatttccaagctgtttttggtttgggtaagaaaaacactaaaggaaaagcgacaaacaaaaatcgaagtgcggcaagggtgaaaggtgccagttcatccagtgcgtagcgaagcaggacaaagttggtgccccaaataaaagtaaccagcagcgccgcagtttgatgaataagagacattaagttgcgtcgaaacttggcaagcaatgagaaaagngtgtttggattaacaagagaatgctgaagccgtaattttggttgagttgcatactaacgcttgcttggcttgcgagaaaccccaagcgagctggcgacatcagatgccggcgatgtgatcaatatctaacagcttggctggtttgcgcgccgcttggcatatttaggttagatgtggaaagatgtgtctcttaaatttggttgaaattcaggagttcacaggtgggattgcaaggtaaagcggcacttgtcggcgtcgctgactacaaaaacgtgcgtaaatacacgggtaagcggaagttctatcttgagcaatgggctgaactgacccagatggcgctagcagatgcaggcttgtcgaaagacgacatcgatggcatttgttgttcttcgattcctgaatctgacctttttgcaccagcaacggtggcggaatatctcggactaaaagtgaattttgcagaaatggtcgatctcggcggcgcctcctctgtcagtatgatttggcgtgcagcagcggccattgaattgggcatttgtgaggcggttgtctgtgctgcaccgggtattcctatcccctctaaccctgacagaggaccgcgcgatcccaatcgattttatggttctaccagcgccaattgggggtcaccccaaacagagttcgacgtgccctacggcaatgtggcccaaaatgtcggctacgcgctgatcgcccagcgatacgcggatgcctacggctatgatgagcgggcgctggcaaaaattgccgccgaccagcgcaccaacgcccaaggtaatccgaaagcggtttttcatggccagccaatcacaattgatgatgtgttgcagagcaagatggttgccgatccattgcatgtattagagatagtcatgccctgtgcgggcggcagcgcctgtattgtcgtaagcgagcgactggcacgtaaatgtaaacatcgccccgtgtatgtcacgggttgtggtgagcacttaacgacgcgttcggtaacttatgctgaagacatgacggtctcgccggtgggcccagccgctgccagtgcctttggcatggcgggcaaaaagcctactgatattgacgtgcttcaggcctatgactgttacaccattacggtgctgttaacgatggaagacgctggtttctgcgccaaaggngagggtttaagttttgtnaacgaacatagtttgacctttgatggcacctttccggtgaacacccatggcggccagctcggtgctgggcaggcagcaggcatggcgggtggtatgtcgcaaccggttgaaggcgttagacaaatcatgggtcgcgccgatggccgtcaggtaaaagattgcaataccgccttgatcaccggtaccggcggtattatgagtgaacaatcggtgatcatcttggagggcgcgtagatgaaaaatgaacgtgataatcatgcgccataccaaagacctcagccgcgcccgacgccgaccagcgagcctttttgggcaggtctagccgcgcagcaagtaaggttacaacagtgcgatgattgcgcgggttgggtttactacccgcgaagccantgnccncattgtttatcttcgaacctgacttggcaagacatctccggagaaggcacgctttacagctacacggtggcacagcagccgactgcccctcagtttgccggtgaggaaccccagttaattggtgtggttgagctgaaagaaggggtangactcaacacagtgatggtcaatgtttcgccggaagaccttaangttggcatgcgtgtgaaacctgtgtttttncaattagcnganacnacgctgctntactttgaaccaagttagcgcggacaaaaannnngcnnnnnnnnnccgnnnncnnccncnnnngncnnnngnannngnnncngnnncnnnannnnnngnnnnnncaannnanannangannn

SEQ ID NO: 1674 - DNA, 4000 bp, Escherichia coli
  misc_feature (246)..(246): n is a, c, g, or t
  misc_feature (353)..(353): n is a, c, g, or t
  misc_feature (477)..(477): n is a, c, g, or t
  misc_feature (540)..(540): n is a, c, g, or t
  misc_feature (626)..(627): n is a, c, g, or t
  misc_feature (630)..(630): n is a, c, g, or t
  misc_feature (674)..(675): n is a, c, g, or t
  misc_feature (1008)..(1008): n is a, c, g, or t
  misc_feature (1035)..(1035): n is a, c, g, or t
  misc_feature (1044)..(1044): n is a, c, g, or t
  misc_feature (1068)..(1068): n is a, c, g, or t
  misc_feature (1098)..(1098): n is a, c, g, or t
  misc_feature (1107)..(1107): n is a, c, g, or t
  misc_feature (1110)..(1110): n is a, c, g, or t
  misc_feature (1119)..(1119): n is a, c, g, or t
  misc_feature (1152)..(1152): n is a, c, g, or t
  misc_feature (1161)..(1161): n is a, c, g, or t
  misc_feature (1164)..(1164): n is a, c, g, or t
  misc_feature (1239)..(1239): n is a, c, g, or t
  misc_feature (1269)..(1269): n is a, c, g, or t
  misc_feature (1303)..(1303): n is a, c, g, or t
  misc_feature (1305)..(1305): n is a, c, g, or t
  misc_feature (1386)..(1386): n is a, c, g, or t
  misc_feature (1440)..(1440): n is a, c, g, or t
  misc_feature (1464)..(1464): n is a, c, g, or t
  misc_feature (1497)..(1497): n is a, c, g, or t
  misc_feature (1524)..(1524): n is a, c, g, or t
  misc_feature (1551)..(1551): n is a, c, g, or t
  misc_feature (1586)..(1586): n is a, c, g, or t
  misc_feature (1602)..(1602): n is a, c, g, or t
  misc_feature (1614)..(1614): n is a, c, g, or t
  misc_feature (1632)..(1632): n is a, c, g, or t
  misc_feature (1820)..(1821): n is a, c, g, or t
  misc_feature (1879)..(1879): n is a, c, g, or t
  misc_feature (1881)..(1881): n is a, c, g, or t
  misc_feature (1964)..(1964): n is a, c, g, or t
  misc_feature (1992)..(1993): n is a, c, g, or t
  misc_feature (2462)..(2462): n is a, c, g, or t
  misc_feature (2573)..(2573): n is a, c, g, or t
  misc_feature (2681)..(2681): n is a, c, g, or t
  misc_feature (2804)..(2804): n is a, c, g, or t
  misc_feature (2888)..(2888): n is a, c, g, or t
  misc_feature (3269)..(3269): n is a, c, g, or t
  misc_feature (3467)..(3467): n is a, c, g, or t
  misc_feature (3581)..(3581): n is a, c, g, or t
  misc_feature (3767)..(3767): n is a, c, g, or t
  misc_feature (3830)..(3830): n is a, c, g, or t
  misc_feature (3903)..(3903): n is a, c, g, or t
  misc_feature (3951)..(3951): n is a, c, g, or t
  misc_feature (3958)..(3958): n is a, c, g, or t
cgggtgagcttttccgcacgctcggtatagttgccgattatatccgcaacgttgaattcgtgtgcatatcctgcctctttatagaacgcatcgtccttttcaagctccgcagtaacagcggatattctgttcatatcaagcgtatgatagtcaagagaatatcttcttgcaatgtttaccgcattgaatctgcctgcgggcataaggtcgtttcttaccatatcgtaatcaacgaatatggcattnagatagctgtcgagcgtttctgcccagtagctgtcgttgtcggtcttctgctcatatacgccggtgattttcacatagtacggctcaacacctgccgcaagcgaaantatcttatatgtattgcccatatttatgccgagcgttttgagtgcgtcctctgaagcaagtccctcgtacacgccgtcaacagaggtctttgagggcagctcgcctctgacgagcttcatatgntcaaggctgtcggtcattcctataagcttcagccttgtagacagctccgaaccgttacgctcnccgtttacgatataaaggcaatcgtcaataagcgttgtcttgctgttctccgaggcgattcctatagcatttatccttgaatccgnnttngatacaacatcgtctatcgttgcctgctgggtattcgtatcggnngttatctgaagcgtctttgtaacggaatacagaccgggatatttgttgttgtcaatctggtactgctccatatcctttatcagcatacgctgtaaggatgcgtccatatatatcggaatagtgctcatcatacctgcggcaagcaggaagccgatgaaaagacacagcaccatccattttgtgttgcgcattttgcgccataataaagtaaacatcttgtattattccttccgaaagtaaagcctgttcagtttgccgtcttacttgacaacaacctcgtcaccctcggaaagtcccgatactatctggatctccgtagcattgcttatgccngtttcgacatccgtttccttcttgacnccgtccttntagacctgtacatagttcttgccngacagcgtctttacaagatacttcggtatnacgattgcnttntccgcctgntccttgatatagcttatatccgcaaccgttccnaccttgccnaanccgggcaggctgcccttgaactcggcatatatcgagcttgtatcctcgtcgccctgttcctttgcctcaacaggngtttttactatagtacccttgtactcctgntcgtcgatagttattgtaacttcctgaccttttntnaattttttatcatcgttgacggccgcctttacatatatcttatcgggatctattattgtagcgataaccttgtacgcctgnaccttcgagccggcgttcatacgctccgcaaagctgacaagtccgtcacacggngcatacagcttggaggtatcgtantcgttctgaagctgtgccagtgtattcttctcnatctcaagctgtaaacggtcattctcngcaccgcttgagccgtatgtattctgngcctgctgaaccttaagctcctgagtgcgtatctngtattcaagatctccngtgttgtattcngcgataaggtcgcccttntttaccgtatctcctgctctgacatatatcgttttaagagtaccgtcacgctctgtaaacgaacagtcctgctgcagctcggatacgcagtagccggtcgcactcgccttgtttattatagtcttctttaccgccttataggtagaatatgtaacatcctccaccttaagcacaggcggatcgagcannttttcttcctccgggaaaaaatagcatccggaagcagagcctgccatagcaagcactncngctattgcggcggcacgcaaaacagtctttttcatttttactttcctttcctttgaacaaagggattttcgcatctttttccntttatagaaaatcaaggattttgctgannttatatgtacaaaatttaaaaaacactatagagatgcttattttaattttagcatttttcacataaattttctacactttttcaaaattaaacgatatgcacaaataccaaaaaggttatttgtttattttgtacaccgtaaagcaactttaaataatcgaaaagcacttgaaaaagccgaacggatttagtataatagtgagtagtgtttatttttcaaattgacatataaaatcaatacgacgggcaggaaaagctcaagggaaggaacaaaataatggctacaaagtatgtattcgtcaccggcggcgttgtgtcgggactcggaaaaggtatcacggcggcttcactcggaagactgctcaagatgagaggttacaaggtaactatccagaagttcgacccctatataaacgttgaccccggtacgatgagtccttatcagcacggtgaagttttcgtaacagangacggtgccgaaaccgacctcgacctcggtcactatgaacgttttatagacgaaaacctttcaaagtacagcaatgtaacaacaggtaagatttactggacagttcttaanaaggaacgtcgtggagattatctcggcggcacggttcaggtaatcccccacataacaaacgaaatcaaatcaagaatatacagagttgcaaactcagccgaaaccacngcagatgttgttataaccgaaatcggcggtacggtcggagatattgaaagcactcccttccttgaggctatccgtcaggtagtttcggatgtaggcagagaaaacgttgtttatatccacgtnactctcctccccttcatcacaggcagcaacgagatgaagacaaagcccacacagcacagtgtaaaggagcttctctcactcggnattcagcccgacattctcgtttgcagaagcgagatggagattcctcaggatatgagagataagattgccagcttctgtaacgttcgcaagcaggacgttatccagaaccttaccgctccttctctttacgaagtacctcttatgcttgaaaaggaaggtcttgcaaaggtagtatgcgatcatctcggacttgatccccgtgttcccgatctcaaggaatgggaggatatggttcagcgtcagtacaacgccacaaagaataccgtaatcggtcttgtaggcaagtacgttgcactccccgacgcttatatttccgttatggaatccctgcgtcacgcaggctttgagaacgaatcgcacgttgaaataaagctcatcaantcagaagaggttactcccgaaacggcagacgagcttctgcatgattgcgacggcattctcgttcccggcggcttcggtgacagaggcatcgagggcaagattgaggctgtccgctacgcaagagagcataagaagccctatctcggtctttgtcttggtatgcacatggctacaatcgaatttgcacgtcatgtggcnggtcttacagacgcaaattcaagcgaattccacgaaggcgagcagaacgttatcgaccttatgcccgaccagaaggatgttgatatgggcggtacaatgcgtcttggcttatanccctgcaagctcgaagcaggtactatttcccgtgaggtttacggcgatgagcttatttatgaaagacaccgccaccgctatgagttcaacaacgtattccgcaagcagctgacagagagcggtcttgttatcgcaggtcagtcgcccgacggaaagctcgttgaaatagttgagcttccgagaagngttcacccctggttcgtggctgttcagttccaccccgaattcaagtcacgtcccaacagatcncaccccttattcaaggactttataagagcgtcgcttgaacaggcaaacaagtaaagaacgaacaataactgcncgtgaaagcgggcggttatattcatattacgggatattttacattccntttacancttcagaccgtatttaatccattaaaagaggtaatttatgac

SEQ ID NO: 1675 - DNA, 4000 bp, Escherichia coli
  misc_feature (184)..(184): n is a, c, g, or t
  misc_feature (252)..(252): n is a, c, g, or t
  misc_feature (357)..(357): n is a, c, g, or t
  misc_feature (702)..(702): n is a, c, g, or t
  misc_feature (714)..(714): n is a, c, g, or t
  misc_feature (716)..(716): n is a, c, g, or t
  misc_feature (879)..(879): n is a, c, g, or t
  misc_feature (990)..(990): n is a, c, g, or t
  misc_feature (1212)..(1212): n is a, c, g, or t
  misc_feature (1350)..(1350): n is a, c, g, or t
  misc_feature (2021)..(2021): n is a, c, g, or t
  misc_feature (2075)..(2075): n is a, c, g, or t
  misc_feature (2378)..(2378): n is a, c, g, or t
  misc_feature (2883)..(2883): n is a, c, g, or t
  misc_feature (3450)..(3450): n is a, c, g, or t
tccttgcacggtaatcgtacagttaaagcttcaaccagtattgatggggagtctcgtcatcacccatcagaagcgggtgtgaatactaaccaaaggcgcatatctctgcaagtgcaatttttactacccatactgtttgcagaaaaaaacgccatcccggtgattttacaggcagttcagcacnctgcagaccgcctgttacggttttaaacggccttgacctggtcggcgatgcgattcgccagttcggtnacctgcgcctcattttcgccttcgaccatgacacgaatcaatggctcagtacctgatttacgcagcagaacgcgtccgcgacccgccagcgctttttccacttcngccgtgacagcttttaccgcgtcactctgaagcggatcatgttcgcccgcaaagcgtacgttaaccaggacctgcggcagcatcttcatgccactacagagatcgtgcaggctcatgtggttacgcaccatcgcagtgagcacttgcaaacttgcaacgataccgtcaccggttgtggttttatccagcaggatcacatgaccggagttctctgcaccgagacgccagcccttctcctgcatcttctccagtacataacggtcaccgactttggcacgggtaaacggaatgccaagctgtttcagcgctaactccagccccatgttactcatcagcgtacccacnacgccgccgcgnanctgtccctgacgcagggcttcacgcgcaatgatgtagaggatctggtcgccatcaactttgtcacccagatggtcaatcatcatgatgcgatcgccgtcaccgtcgtaggccaggccgatatcggccttctccgccagcacgcgctgctgcagcagtttgagntcggtggcaccgcactctttgttgatgttcatgccgtctggctggacaccgatagcaatcaccgtcgcgcccagttcacgcaatacattcggcgcaatgtggtaggtggcnccattggcgcagtcgaccacaattttcaggccattcagattcagttcgctggggaacgtccctttgcagaactcaatgtaacgccctgctgcatcgacgatgcggctggcgcggcctaactgcgctgattcaacgcaggtaatcggcttttccatctccagctcaatcgcctcttcaacgtcgtcgggcagtttggtgccctcggacgagaagaatttaatnccgttgtcgtcaaacgggttatgtgacgctgaaatcacaatgcccgcctctgcgcggaaggtacgggtcagataggcgatggctggtgtcggcatcgggccggtaaaggcggccgtcaggcctgctgcggcgagaccngcttccagcgcggactccagcatatagccagagatacgggtatctttaccgatgatgatcttctttgaaccgtggcgcgccagcactttacctgcggcccagcccagcttcaggacgaaatcgggggtgatgggtgcttcaccgactttgccacgaatgccgtctgtaccgaaatatttacgattactcatgatactccttttgctcttcgggtcgcttcgaccacgcgcatcgcttcagccgtctcttttacatcatgggcgcgaataatctgcgcgccctgcatagcagcaatcaccgcgcaactcaggctgccggttaaacgctgtgacgggccgacgtttaacagctggccaatcatcgatttacgcgacatccccactaacagcggcaggccgaagtggtgaaaatcgccaagatgagccagcagttcataattgtggctgagatttttaccgaaaccgaagcccgggtcgagtatcagacgctcttttttaatgcccgctgcttcgcagcgcgctatctgctgagcgaagtaagtgtccacttcgcttaaaatattttcgtaaaccggtgcctgctgcatggtgcgcggttcgccctgcatatgcattaaacagacgggcagcccggtcgaggcggcggcttccagtgctccgggttcagaaagngaacgcacgtcgttaatgatgtgagcacccactcgcgcggcttcccggatgacntcagctttagaggtgtccactgaaatccagacttcgaaacgctgggcaatggcatcgatgaccggaatcacccgctccagctcctcctccacactcacttcatccgcgccaggacgggttgattccccacccacatcgatgatggttgcgcctgcattgaccatctcattggtatgcgtcagcgcatcgaccagcgcgttatgctttccaccatctgaaaaggagtccggcgtgacgttaagaatgcccatcacatgtggaaaagataaatcgagatgggaatcacgggcgaacaacttcatngcggaaactccttgctgatcaatatctggatgtaaaaaaccccggaccagccggggttttgtctgacgatgttgcgtcttatttgttgtactgctctgacatggtattgcctgggtttggcgtacgcggttcatcaaccggacgtggcgcctttggcgtaccgttgctgtctgagttgctgcctggatcttcccagcccgctggcggacgcacttcgcggcgcgccatcaggtcgtcgatctgcggtgcatcaatggtttcatacttcatcagcgcgtctttcatcgcgtgaaggatgtccatgttctcacccagaatctgacgagcacgctggtagttgctgtcgatcaggtgcttaacttcctggtcgatgatgcgggccgtttcatcagacatatgtttcgctttcgcgacagaacgtccgaggaacacttcaccctcttcttctgcatagagcaacggacccagtttttcagagaagccccactgcgtcaccatgttacgngccagattggtcgcaactttaatatcgttggacgcaccggtagaaacacgttctgcaccgtagatgatctcttctgccagacgaccgccgtaaagcgttgagatctggctttccagtttctgacggctggcgctgatcgcgtcgccttcaggcaggaagaaggtcacacccagtgcgcgaccgcgcgggataatcgttactttatgaaccggatcatgctctggcaccaggcgaccaataatggcgtggcctgcttcgtggtaggcagttgactctttctgcgattccgtcatcaccatggagcgacgttccgcacccatcatgattttgtctttcgctttctcgaactctaccatcgaaaccacacgcttgtttgaacgggccgcgaacagcgctgcttcgttaacaaggttggccagatcggcacccgagaagcctggcgtaccacgtgcaatgattgctgcatcaacatcagttgccagcggcacacgacgcatatgcactttcaggatctgctcacgaccgcgaacatctggcaggccaacaacaacctgacggtcaaagcgncctggacgcagcagcgcagggtccagtacgtcaggacggttagttgcggcgataacgataataccttcgttaccttcgaaaccatccatctcaaccagcatctggttcagcgtctgctcacgttcgtcatgtccaccgcctaaaccggcgccacgctgacgaccgactgcgtcgatctcatcgataaagatgatgcacggagccgcttttttggcctgttcgaacatgtcacgcacacgggatgcaccgacaccgacaaacatttccacaaagtcagaaccggagatggtaaagaaaggcaccttcgcttcaccggcaatcgcttttgccagcaaggttttaccggtacccggtggccccaccatcagaacgccttttggaatcttaccgcccagcttctggaaacggcttggctcacgcagatattccaccagctcagcaacttcatctttcgcttcgtcacaacctgctacgtcggcgaaagtggttttaatctggtcttccgtcaacatgcgggctttgctcttgccgaaggacatcgcgcccttac

SEQ ID NO: 1676 - DNA, 4000 bp, Escherichia coli
  misc_feature (1987)..(1987): n is a, c, g, or t
ctcgcgtctcctcgtcgccgacgccatccaccgccgactcgcctctcgcctcagttcaccgcgcgctcgcgagcgccgcgcctcgagcgagtgcggtcaccatgctcaccgcgcgctgcgtcatcgcgctccccgcgcgccgcgcgtcgcgcgctgcgtcccgtcgagcgcgcgcgccgtcgacgtcgacgtcagccatatctcccggtcgcgctctatccgcgtcctacgacgccgcggacgcgatcgacccgatgtcgagctacgatggcgcgtcctgcgtcgtcaccgactccatcgacgccgacgagatcgaccgcacgcgcgtgggggagacgctgagggaacaaatcgcaaacatgggaggggagcagctgatggacccgcgagacttcgtgtccacggacgcgcagcgacgacagtgcgcggtgttgttcgcgtcgtgcgcggcgttagtcgggaaggggatgtatgagttcggatgcgatggattcacggcgatggaggcgatgatggctgtcggaacgatcgggttggcgtactggacgagcgacctgggcacggggatatttcactggagcgtggataactacgggagtaaggcgacaccgttgctcggtggggtgattgatgcgtttcaagggcaccacaaatacccgtggacgatcacgaagcggcagtgggcgaataatgtgcacaccacgtgcgtggcgccgctcgtgttcaccacgccgacgctgttgctcaacgatcgggcgacggatttgatattcgtcggcgttttcacgtctttgatcgtacttagtcaacagttccacgcctggagtcacatgaaaaagagcgagttgccgccgctggtgctcaaggcgcaagatatggggcttttggtcggacgtcgcgaccatgggcagcaccacaagtcgccgtttgagggtcactattgcatagtcagtgggtactggaatccgattctggacggcagcgggttttttcgcgcgctcgaacaagccgtgttcaaggccacgggcacggctccgcgctgctggtcggatgacgtcgagttcatcgtgcaggaaagcgcccccgaaggctgggggcgaggcgtgctcaagtgagctcgtgagttgtatgaattaaattgcatttttctatcgcgtacagctgcccctattgggctgtttgcggttgtagtcgttgatacattttcgcttgtaaaaagcactctctgatgatacatgtcgtcctcggcgtcggcgaaatcacgctcgtcgcaacgccaacatctcgtcgacgacgtcgacgcaatcaatgtgacgattcaccaacgcgatgtcgcgcggcgagacaggcgcattattcgcaccgagcgagtgatccgtgtgcaaacgatcggcctcccactgccccacttcgacgctcgcgccgagtcgaagcagcgttcgagccgcggcggcttccccccactcgcacgcagaaaacaatgccgtctttccgttgtaatacctcgcatcgatatccgccccaccgcgcacgagtaattccaccgaagcgcaatctccgcgcttcgccacggcgtgcaacggcttccatccttgatgatggtttcgacagttggcgtccgcgccccctcgcaacaacaagcccacgcacgacgcccgcgcgtcgtcctcgacgccatccgcgcacgacgccgacaacaacacgtcgtccacgtccatatcgtgcgccatgagcacccgcacgcactcgcactccgccctcgccgccgccgcgcgtcccgctcgcccgagcgtctccgcccagtcgcccgcgctcgcccctccctcgcgcttctctagcattttctccagctcgcgatgccgtccgcggctcgcgcacaacgcgagcgcggcgccgacgtcggcgtgcgggaacgacacgaggacttccagggcgtcccagttctcgtgcagggctacctgttgcaagtcggcaaaccaacgcttcnaacgagggtcgttgcgccgcgcgaacgaggacgcgacgctcagcgcggtggcgggaacttgctgcgcgtgcgcggcgcgcgcgacggggtgagccatcgcgtcgcgcgccgctcgacgacgccgcgcagtgggggggacggcggtttcggcggagacttgcttactaaaagcgtcgagtcgagtattaggacgacttcgtcttggcttccgcggcgtcgcgctcggcctgggcctcttctaatccttcgcagtaattccacgtcacgccgacttctttcgccagagcggcgcgaatgaaggtggcgccgaggacgcccgggacgatgtacaacagcgccggttgggcggcgtcaaagacgttcatgacgacgatggtggtgacgatcccgacgagatagccgaacgcgacggcggggaaatacgttgtcacagtctttccgtcgtcgcggaccgttcgagaggcggtcgcagcttttttggacgccgatctcgtgagcgactttctcggctcgagcgccgccgcgcgtctcgcgttgtccatcctcaaaatcatcgccacgtaaagccctggaacgacgatatcccccagacctagcatgctaaacggtccatcagcgccctcgatcgcactggcggcgactcgcgggaaaagtagcttgatcggcgcgtcgaacgaccgcgccacgctcaccatcaccggcgtgcaaaacacccaaaacacgtcgtacacgaacaaccccgcgagcaagattgacccgatctgcacgctatcaatcgtcaaatactcgattccttgcagcgcaaacgacattcccagcgcattattcgccaaccaatgacgcgaacgaacgtacgccgccgttcccgccaacgccgcgacgcccgccgccgcctccgccagcgtgcactccgccgtccaccgctcgccgttcacccacttcatctccggcaccgaaaacagttcgtagctcacgagctcgcgtcccccgaacgcaaatttgtgcacgaccggggtcaggatcgcgctcatcgccacgacgccgagcatcccaaagtacgccgtcgcgcacacgtcgagcacgtttttgggcaaaaacttgaacgccagaaacgccccgaacagcacgcacgacccgagcagagggaacttttgcgcgtcttccttggtcatgacctctcccgagccctcgctcgccggtcgcacgcttcggtacgcgccggcgacgacgctcagcgtgctcacggcgacgatctgggcgttgggatcgacgaccgcgacggtcggcgcgagcgcgcagagcagcagggcgacgtgcgcgagcggcgcggcgatcgggtcggcgccgaccatcgtcggacgcgcgctcgagggcatggcgacgtcgcgcgggtgagtgacgagacgacgagcgcgcgcgaggggaagacgagacgacgctccgatacaaacttacgacgatgacgtcgtctacgagcgcacctccctcgcggtgcgcgcggtgactactctatcagcgcgtccgctcgccgcgggcgcgtcggcttgctgctgtaactgcgcctcggtcgccttggcgagcgcgtcgttcgcgtaccgtcgcgcgaaccgccgcgcggcggcgagcgccgcgcccccgtgcgtcccgacgcgctcgaacgtcgtcgccagcgcgtgatcgacgcgcgactcgttcgcgaccaagatcggcgctaagaacctatcgtacacgtacagcgcgccctgaaacctcggatgccagagatagacgctaaacgccacctgcgccgcgcgcgtcagtccttcgatattcgaatcctccgcgcgcgtccgcgcgtcgcgcgcgtcccgtcccgtcccggcggtcaccggcgcaccttacactcccaatacatcaccgctcgtcccccgaacgcgcgatccagcgccggctgcgccgccatccacgcgctcgcgacgacccagtacacgcaccacccgcgcgcgttgtccgcgcgcttgcggtcgtgctcga

SEQ ID NO: 1677 - DNA, 4000 bp, Escherichia coli
  misc_feature (5)..(5): n is a, c, g, or t
  misc_feature (71)..(71): n is a, c, g, or t
  misc_feature (125)..(125): n is a, c, g, or t
  misc_feature (355)..(355): n is a, c, g, or t
  misc_feature (812)..(812): n is a, c, g, or t
  misc_feature (959)..(959): n is a, c, g, or t
  misc_feature (1449)..(1449): n is a, c, g, or t
  misc_feature (1515)..(1515): n is a, c, g, or t
  misc_feature (1581)..(1581): n is a, c, g, or t
  misc_feature (1629)..(1629): n is a, c, g, or t
  misc_feature (1991)..(1991): n is a, c, g, or t
  misc_feature (2249)..(2249): n is a, c, g, or t
  misc_feature (2555)..(2555): n is a, c, g, or t
  misc_feature (2675)..(2675): n is a, c, g, or t
  misc_feature (2714)..(2714): n is a, c, g, or t
  misc_feature (2780)..(2780): n is a, c, g, or t
  misc_feature (2782)..(2782): n is a, c, g, or t
  misc_feature (2816)..(2816): n is a, c, g, or t
  misc_feature (2918)..(2918): n is a, c, g, or t
  misc_feature (2927)..(2927): n is a, c, g, or t
  misc_feature (2930)..(2930): n is a, c, g, or t
  misc_feature (2960)..(2960): n is a, c, g, or t
  misc_feature (2990)..(2990): n is a, c, g, or t
  misc_feature (3029)..(3029): n is a, c, g, or t
  misc_feature (3035)..(3035): n is a, c, g, or t
  misc_feature (3074)..(3074): n is a, c, g, or t
  misc_feature (3086)..(3086): n is a, c, g, or t
  misc_feature (3098)..(3098): n is a, c, g, or t
  misc_feature (3107)..(3107): n is a, c, g, or t
  misc_feature (3116)..(3116): n is a, c, g, or t
  misc_feature (3121)..(3122): n is a, c, g, or t
  misc_feature (3131)..(3131): n is a, c, g, or t
  misc_feature (3137)..(3137): n is a, c, g, or t
  misc_feature (3140)..(3140): n is a, c, g, or t
  misc_feature (3170)..(3170): n is a, c, g, or t
  misc_feature (3179)..(3179): n is a, c, g, or t
  misc_feature (3215)..(3215): n is a, c, g, or t
  misc_feature (3227)..(3227): n is a, c, g, or t
  misc_feature (3433)..(3433): n is a, c, g, or t
  misc_feature (3517)..(3517): n is a, c, g, or t
  misc_feature (3520)..(3520): n is a, c, g, or t
  misc_feature (3535)..(3535): n is a, c, g, or t
  misc_feature (3568)..(3568): n is a, c, g, or t
  misc_feature (3574)..(3574): n is a, c, g, or t
  misc_feature (3589)..(3589): n is a, c, g, or t
  misc_feature (3601)..(3601): n is a, c, g, or t
  misc_feature (3616)..(3616): n is a, c, g, or t
  misc_feature (3619)..(3619): n is a, c, g, or t
  misc_feature (3658)..(3658): n is a, c, g, or t
  misc_feature (3694)..(3694): n is a, c, g, or t
  misc_feature (3715)..(3715): n is a, c, g, or t
  misc_feature (3727)..(3727): n is a, c, g, or t
  misc_feature (3739)..(3739): n is a, c, g, or t
  misc_feature (3742)..(3742): n is a, c, g, or t
  misc_feature (3775)..(3775): n is a, c, g, or t
  misc_feature (3787)..(3787): n is a, c, g, or t
  misc_feature (3796)..(3796): n is a, c, g, or t
  misc_feature (3820)..(3820): n is a, c, g, or t
  misc_feature (3823)..(3823): n is a, c, g, or t
  misc_feature (3904)..(3904): n is a, c, g, or t
  misc_feature (3937)..(3937): n is a, c, g, or t
  misc_feature (3949)..(3949): n is a, c, g, or t
  misc_feature (3952)..(3952): n is a, c, g, or t
  misc_feature (3958)..(3958): n is a, c, g, or t
  misc_feature (3966)..(3966): n is a, c, g, or t
tagcngtgatgtattgtttatcttttacttcagattctttaacacgaggagttaaatattgaccagtagantttgtacgagggaatgcagttgcagttactgcaaaaccggaacctaacttcatntatttttggaagttagtcatattagtatcttcataatctttatcgtcttcttcgaacgctaatgcagatgcaccaggagtcaaaagataatcgttatgagaatacattttcaaaccgacagttacgaaagcttcattaaggtctttatccattacagaataaattggatattcagcattaacgtctgtgttaatacgcaatgtatggaaatatttaccagtgaaggaacngaaaggtttaggagattttttgtttttaattacatgtgtgcgaacttctgtgcggcatggaatcaaagaacgtttacggccgatgaaatatgtaccagggaagatagaacccatagccaaatcataagagtcgttacgaagagtaacgtcttggccttttttatttacgatagaaagagttacgacgttgttcaattggtgtttgttgatataacgaattacttcgctaatagtagtgtcggcattaaaacctgcacccatcaaacctaattgaatgtcgattttgatcatttcgttttcatcgttaaccattgcattgtaacgttcataagcagttgctttagaaactggtttatacaatgtgaaaacttcttgaccaggagtattatcgaaagtaaagtatacttgttttgctttattggaagggaaacgagattttacacgtaaacgaagagtntcgtcagaacgtaatttaaaatctttttgagcttcggaaccaccaatacggaaaccataaagagtacggcaaccagagttgtaagcatcggataatgctgcagtcaagtctacttcacgtttagttgtgcgatcataagtatcgccntaagtatatttagcatatgtcggatcataaataggtactggaacaccgttaggaccatcaaatgctgtaccgatacaaagaactgcgtcagttgtaccgaattgagaatcgtcataaagtttcttctttacagaattgacttcgacgaatacaccaggaagatctcgaaggatttcctctttaaaggtgaaagccatatttaaacctcttaagaaattatttaccaagatttagtaaacgttcgataagtttgctagttacaacatacattttatcgatgtttaaagtatagcgaacacttctaatagaatatttttcacgatacataacgtaggattcgtcagttaagcgttgatcgtaaagtaattcagatacaccacgcatttttaaataaccagtgtagtctaccataagctcttcaaattctttaagaactttattagcttggtcgtatgaagttgcgaagatgtcaaattggatgacgtatctnaatgcatgacgatacacatcgacaccttcttcttcaatattttctttaacgggatatttatcgtcnggacgataatcaggatttcctggagcacgacgaatagtcgtttccattaatcttggttttaaatcnttagcaggtacaccgctaataattttaaagaaaatataaggatgattnatttcctgatctcggtcgttaatcgtaacgccttcatcaggactcatctttacgttatcttcacgaaatgctttctctacgagttctacgagtaacgcaataaattcgtcgaaactaatggaactgtcagcccgtaatcggtcgagacgttttcgactattcagtatcctaccgggattagtgactgcaaccaattgttctttttgacgccgtacttggtcgagtacaaaacgttcattaatttcttgtgtcatagtctttgctccgcagtataagattctgttgtaaataatggatataatgtatatcgtaaaatgatgtccacaccatatccatgattactgatttgttcttcaatgctntcgatatgataatcgtaaagaacaaagccaacattatctttaagtaaattatctaaccgttcttttattttatttaaataaaacttacggtagttcttacctatatattcttcgaaatccatttctctgattaagtaattaatgatccgcattaccataacagatttattaggattttcgtcagataagttaactaaattttcaatagtagtaccagtccgatagttatttttgaaataacaaacattaggaagcatntctttataatctataataaagtcagtatcctcatcatcgaaatcggggtacttattgataggcgtggctgctaatttcgcagctacaactatattacagaagtgcacatatttcaggttgttgccgacaaaaattatattatctaagtatttgttcttattgttaatagcagtatactctgctaacttattattataatctttattaaatgcatcgatatcttcgtataatgaactatgattatcggtagcaaaaataaaacttctattctttacacaagaagaagataataaatttaaataatgntcggttaaattcttattatatcgatcagtatatttatcggagaatttaatctgagtcggacaaatataagcgaagtcgtaatcgataagttgttttgctatattttgaaaatcagatatngttctcatattcactaaatatatggatggcgctccatantttttagcgatcgtatatgcttgatataaatcagaatcttttccgtattcttcttcgacttgtganantaaatcgaatttctcgatcttacaagttttattngtatattcggagttgccgataattaataagctagtatgcttatcttccattatctaaacacctccgatcaatgctttaaagtttttcataaatgcttctggntttcgtttntantcgacaccattagcttcataataaacacantccatagtattagaataccagtccattacntatgtaacgtttataattttatccttgaagacaataatntctccngggaaaactggaaattcatttctaagataaatatcgtanccacgcattaanaataatttattntcggcactntctgtcganaatannggttgaagntgtgcncgngcttcccgtatcgttattttatgtccaagncctaaacanttttcacaaaatggatcaccgtgttttgaaaccggntccatacatgtncaattaatatgtttatttgcttgaattaaccatacaggaacttccattaattggattaaaccattaatgcgttcatcgaggtttttcattatgttttcctcaatgctttaagagaacgagataaattatctaacaagtctgtcgggaatgtatgtaacttacgtttttcagtataagaacgttttccgacacgaggttcagctctncccatagtaagatatgtaggatcgacaattaacttttggaaaatctccatctcggctttaatcattttaattaaatcagataanganggagctccacttccnctagaactagaagaactagatccaccagattcngtcganccaaaactaatattnccgatatgaccngaaatcttaccggangtngaagtcgttacagcatgtttactaacaagacttaacgtngctcttaatttacaaaattgttgtaaaagataaggnaagtcggctctattttcatanccaggaatttgntctaatagaaantgngcaaaccgacttgcttcttttaatgcgtataanacttctgtatcnctagcatcnaatacattgattagataattaacntcnccgagcgtataaaaattactaatttgttctgatgctaccgtatagactttatactttaatacttttttcccgtcgacagantctaattttttaattctaatttcgtataaagantcaggtttagtnccnccgacnggtttaanttctaaacgattaccaaatatcgtatactcaaaa

SEQ ID NO: 1678 - DNA, 4000 bp, Escherichia coli
  misc_feature (1989)..(1989): n is a, c, g, or t
  misc_feature (1992)..(1992): n is a, c, g, or t
  misc_feature (2817)..(2817): n is a, c, g, or t
  misc_feature (2834)..(2835): n is a, c, g, or t
  misc_feature (2838)..(2839): n is a, c, g, or t
  misc_feature (2845)..(2845): n is a, c, g, or t
  misc_feature (2847)..(2847): n is a, c, g, or t
  misc_feature (2850)..(2851): n is a, c, g, or t
  misc_feature (2855)..(2857): n is a, c, g, or t
  misc_feature (2861)..(2861): n is a, c, g, or t
  misc_feature (2867)..(2867): n is a, c, g, or t
  misc_feature (2869)..(2869): n is a, c, g, or t
  misc_feature (2881)..(2881): n is a, c, g, or t
  misc_feature (2902)..(2902): n is a, c, g, or t
  misc_feature (2904)..(2904): n is a, c, g, or t
  misc_feature (2909)..(2910): n is a, c, g, or t
  misc_feature (2923)..(2923): n is a, c, g, or t
  misc_feature (2928)..(2928): n is a, c, g, or t
  misc_feature (2939)..(2939): n is a, c, g, or t
  misc_feature (2943)..(2944): n is a, c, g, or t
  misc_feature (2947)..(2948): n is a, c, g, or t
  misc_feature (2950)..(2950): n is a, c, g, or t
  misc_feature (2952)..(2952): n is a, c, g, or t
  misc_feature (2955)..(2958): n is a, c, g, or t
  misc_feature (2960)..(2960): n is a, c, g, or t
  misc_feature (2964)..(2964): n is a, c, g, or t
  misc_feature (2974)..(2975): n is a, c, g, or t
  misc_feature (2977)..(2977): n is a, c, g, or t
  misc_feature (2999)..(2999): n is a, c, g, or t
  misc_feature (3003)..(3003): n is a, c, g, or t
  misc_feature (3005)..(3005): n is a, c, g, or t
  misc_feature (3018)..(3019): n is a, c, g, or t
  misc_feature (3034)..(3034): n is a, c, g, or t
  misc_feature (3042)..(3042): n is a, c, g, or t
  misc_feature (3044)..(3044): n is a, c, g, or t
  misc_feature (3049)..(3049): n is a, c, g, or t
  misc_feature (3051)..(3053): n is a, c, g, or t
  misc_feature (3055)..(3055): n is a, c, g, or t
  misc_feature (3058)..(3058): n is a, c, g, or t
  misc_feature (3060)..(3060): n is a, c, g, or t
  misc_feature (3063)..(3063): n is a, c, g, or t
  misc_feature (3065)..(3066): n is a, c, g, or t
  misc_feature (3070)..(3070): n is a, c, g, or t
  misc_feature (3078)..(3078): n is a, c, g, or t
  misc_feature (3084)..(3084): n is a, c, g, or t
  misc_feature (3087)..(3087): n is a, c, g, or t
  misc_feature (3089)..(3089): n is a, c, g, or t
  misc_feature (3100)..(3100): n is a, c, g, or t
  misc_feature (3105)..(3105): n is a, c, g, or t
  misc_feature (3110)..(3110): n is a, c, g, or t
  misc_feature (3120)..(3120): n is a, c, g, or t
  misc_feature (3122)..(3122): n is a, c, g, or t
  misc_feature (3133)..(3133): n is a, c, g, or t
  misc_feature (3135)..(3135): n is a, c, g, or t
  misc_feature (3138)..(3138): n is a, c, g, or t
  misc_feature (3141)..(3141): n is a, c, g, or t
  misc_feature (3148)..(3148): n is a, c, g, or t
  misc_feature (3152)..(3152): n is a, c, g, or t
  misc_feature (3156)..(3157): n is a, c, g, or t
  misc_feature (3162)..(3162): n is a, c, g, or t
  misc_feature (3167)..(3167): n is a, c, g, or t
  misc_feature (3173)..(3173): n is a, c, g, or t
  misc_feature (3176)..(3176): n is a, c, g, or t
  misc_feature (3183)..(3183): n is a, c, g, or t
  misc_feature (3191)..(3191): n is a, c, g, or t
  misc_feature (3214)..(3215): n is a, c, g, or t
  misc_feature (3217)..(3217): n is a, c, g, or t
  misc_feature (3219)..(3219): n is a, c, g, or t
  misc_feature (3227)..(3227): n is a, c, g, or t
  misc_feature (3230)..(3230): n is a, c, g, or t
  misc_feature (3232)..(3234): n is a, c, g, or t
  misc_feature (3237)..(3237): n is a, c, g, or t
  misc_feature (3240)..(3240): n is a, c, g, or t
  misc_feature (3243)..(3245): n is a, c, g, or t
  misc_feature (3251)..(3252): n is a, c, g, or t
  misc_feature (3255)..(3255): n is a, c, g, or t
  misc_feature (3263)..(3264): n is a, c, g, or t
  misc_feature (3283)..(3284): n is a, c, g, or t
  misc_feature (3291)..(3291): n is a, c, g, or t
  misc_feature (3296)..(3296): n is a, c, g, or t
  misc_feature (3298)..(3298): n is a, c, g, or t
  misc_feature (3300)..(3301): n is a, c, g, or t
  misc_feature (3303)..(3303): n is a, c, g, or t
  misc_feature (3306)..(3306): n is a, c, g, or t
  misc_feature (3310)..(3310): n is a, c, g, or t
  misc_feature (3313)..(3313): n is a, c, g, or t
  misc_feature (3317)..(3317): n is a, c, g, or t
  misc_feature (3320)..(3320): n is a, c, g, or t
  misc_feature (3323)..(3323): n is a, c, g, or t
  misc_feature (3327)..(3327): n is a, c, g, or t
  misc_feature (3329)..(3329): n is a, c, g, or t
  misc_feature (3331)..(3331): n is a, c, g, or t
  misc_feature (3334)..(3334): n is a, c, g, or t
  misc_feature (3336)..(3336): n is a, c, g, or t
  misc_feature (3338)..(3339): n is a, c, g, or t
  misc_feature (3365)..(3367): n is a, c, g, or t
  misc_feature (3369)..(3369): n is a, c, g, or t
  misc_feature (3377)..(3377): n is a, c, g, or t
  misc_feature (3383)..(3383): n is a, c, g, or t
  misc_feature (3387)..(3387): n is a, c, g, or t
  misc_feature (3395)..(3395): n is a, c, g, or t
  misc_feature (3399)..(3399): n is a, c, g, or t
  misc_feature (3404)..(3404): n is a, c, g, or t
  misc_feature (3409)..(3411): n is a, c, g, or t
  misc_feature (3419)..(3419): n is a, c, g, or t
  misc_feature (3426)..(3427): n is a, c, g, or t
  misc_feature (3429)..(3431): n is a, c, g, or t
  misc_feature (3444)..(3444): n is a, c, g, or t
  misc_feature (3446)..(3446): n is a, c, g, or t
  misc_feature (3449)..(3449): n is a, c, g, or t
  misc_feature (3454)..(3454): n is a, c, g, or t
  misc_feature (3459)..(3459): n is a, c, g, or t
  misc_feature (3463)..(3463): n is a, c, g, or t
  misc_feature (3467)..(3467): n is a, c, g, or t
  misc_feature (3470)..(3470): n is a, c, g, or t
  misc_feature (3480)..(3480): n is a, c, g, or t
  misc_feature (3484)..(3484): n is a, c, g, or t
  misc_feature (3488)..(3488): n is a, c, g, or t
  misc_feature (3499)..(3499): n is a, c, g, or t
  misc_feature (3502)..(3502): n is a, c, g, or t
  misc_feature (3509)..(3509): n is a, c, g, or t
  misc_feature (3515)..(3516): n is a, c, g, or t
  misc_feature (3519)..(3519): n is a, c, g, or t
  misc_feature (3526)..(3526): n is a, c, g, or t
  misc_feature (3528)..(3529): n is a, c, g, or t
  misc_feature (3541)..(3541): n is a, c, g, or t
  misc_feature (3544)..(3544): n is a, c, g, or t
  misc_feature (3551)..(3551): n is a, c, g, or t
  misc_feature (3555)..(3555): n is a, c, g, or t
  misc_feature (3560)..(3560): n is a, c, g, or t
  misc_feature (3570)..(3571): n is a, c, g, or t
  misc_feature (3573)..(3573): n is a, c, g, or t
  misc_feature (3575)..(3575): n is a, c, g, or t
  misc_feature (3580)..(3580): n is a, c, g, or t
  misc_feature (3584)..(3584): n is a, c, g, or t
  misc_feature (3588)..(3588): n is a, c, g, or t
  misc_feature (3590)..(3590): n is a, c, g, or t
  misc_feature (3593)..(3593): n is a, c, g, or t
  misc_feature (3596)..(3597): n is a, c, g, or t
  misc_feature (3603)..(3603): n is a, c, g, or t
  misc_feature (3608)..(3608): n is a, c, g, or t
  misc_feature (3610)..(3610): n is a, c, g, or t
  misc_feature (3614)..(3614): n is a, c, g, or t
  misc_feature (3619)..(3619): n is a, c, g, or t
  misc_feature (3622)..(3623): n is a, c, g, or t
  misc_feature (3631)..(3631): n is a, c, g, or t
  misc_feature (3633)..(3633): n is a, c, g, or t
  misc_feature (3645)..(3645): n is a, c, g, or t
  misc_feature (3647)..(3647): n is a, c, g, or t
  misc_feature (3649)..(3649): n is a, c, g, or t
  misc_feature (3652)..(3654): n is a, c, g, or t
  misc_feature (3663)..(3664): n is a, c, g, or t
  misc_feature (3667)..(3668): n is a, c, g, or t
  misc_feature (3670)..(3670): n is a, c, g, or t
  misc_feature (3673)..(3673): n is a, c, g, or t
  misc_feature (3677)..(3677): n is a, c, g, or t
  misc_feature (3679)..(3679): n is a, c, g, or t
  misc_feature (3683)..(3683): n is a, c, g, or t
  misc_feature (3687)..(3687): n is a, c, g, or t
  misc_feature (3703)..(3703): n is a, c, g, or t
  misc_feature (3709)..(3709): n is a, c, g, or t
  misc_feature (3713)..(3713): n is a, c, g, or t
  misc_feature (3720)..(3720): n is a, c, g, or t
  misc_feature (3731)..(3731): n is a, c, g, or t
  misc_feature (3737)..(3737): n is a, c, g, or t
  misc_feature (3749)..(3750): n is a, c, g, or t
  misc_feature (3756)..(3756): n is a, c, g, or t
  misc_feature (3759)..(3759): n is a, c, g, or t
  misc_feature (3761)..(3761): n is a, c, g, or t
  misc_feature (3767)..(3767): n is a, c, g, or t
  misc_feature (3769)..(3769): n is a, c, g, or t
  misc_feature (3777)..(3778): n is a, c, g, or t
  misc_feature (3786)..(3787): n is a, c, g, or t
  misc_feature (3790)..(3790): n is a, c, g, or t
  misc_feature (3798)..(3800): n is a, c, g, or t
  misc_feature (3802)..(3802): n is a, c, g, or t
  misc_feature (3806)..(3806): n is a, c, g, or t
  misc_feature (3808)..(3808): n is a, c, g, or t
  misc_feature (3813)..(3813): n is a, c, g, or t
  misc_feature (3816)..(3816): n is a, c, g, or t
  misc_feature (3821)..(3821): n is a, c, g, or t
  misc_feature (3828)..(3828): n is a, c, g, or t
  misc_feature (3835)..(3835): n is a, c, g, or t
  misc_feature (3837)..(3837): n is a, c, g, or t
  misc_feature (3839)..(3840): n is a, c, g, or t
  misc_feature (3846)..(3847): n is a, c, g, or t
  misc_feature (3852)..(3852): n is a, c, g, or t
  misc_feature (3854)..(3854): n is a, c, g, or t
  misc_feature (3864)..(3864): n is a, c, g, or t
  misc_feature (3866)..(3867): n is a, c, g, or t
  misc_feature (3872)..(3873): n is a, c, g, or t
  misc_feature (3875)..(3875): n is a, c, g, or t
  misc_feature (3878)..(3878): n is a, c, g, or t
  misc_feature (3890)..(3890): n is a, c, g, or t
  misc_feature (3893)..(3894): n is a, c, g, or t
  misc_feature (3900)..(3900): n is a, c, g, or t
  misc_feature (3902)..(3902): n is a, c, g, or t
  misc_feature (3904)..(3904): n is a, c, g, or t
  misc_feature (3907)..(3907): n is a, c, g, or t
  misc_feature (3910)..(3910): n is a, c, g, or t
  misc_feature (3913)..(3913): n is a, c, g, or t
  misc_feature (3919)..(3919): n is a, c, g, or t
  misc_feature (3921)..(3921): n is a, c, g, or t
  misc_feature (3928)..(3928): n is a, c, g, or t
  misc_feature (3941)..(3941): n is a, c, g, or t
  misc_feature (3944)..(3944): n is a, c, g, or t
  misc_feature (3946)..(3946): n is a, c, g, or t
  misc_feature (3948)..(3949): n is a, c, g, or t
  misc_feature (3952)..(3952): n is a, c, g, or t
  misc_feature (3956)..(3957): n is a, c, g, or t
  misc_feature (3961)..(3961): n is a, c, g, or t
  misc_feature (3969)..(3969): n is a, c, g, or t
  misc_feature (3979)..(3979): n is a, c, g, or t
  misc_feature (3981)..(3981): n is a, c, g, or t
  misc_feature (3983)..(3984): n is a, c, g, or t
  misc_feature (3987)..(3989): n is a, c, g, or t
  misc_feature (4000)..(4000): n is a, c, g, or t
taaattacgaattaaaatattagtaatataaattttttttattgataatttaattttattataaaaactttattctttcacttccctccaaacttatatttattatcaaatattaagttggtaaaatttgtcagttttggtcagtttacgtttttagttaaaatgttggccaatttttcttcagatttgtattaattaaattcaattttaattaggaatgaagatattgtagaattctaatttttgaattgattattttaagccaatatcatctactataatctatatctcctttgagaattgttatatatacttctttgtcttttgtatatttaatgattttgttatttgaatcttttttaattttaagcattcatttcgatgtaatgttattttctagtgtttatcaacaaatatcataactttatttttatataaattatctaattccttattgattgcttgtttctgattaatccaattctctctatatgcatcattataattagatgaaatatcggtattaattgagaagattgttgagtattctctatttttatctagtaatttagaaaataaatttttatagtattaatattgatataaagtaattaattttattatttatttttatattataattattaattattattataacacttttgacttattatcatttttttgtagtattatatataaatatgtatatatttatttttttaattttttatattcaaatttatttaaacctttctgttaattatattcgataaaattataattaaattttgtatattagtgaattgaaattaaaaatatctatttctctaatatatctttatgattagaaggtgttgaagtcattgaattattaattgctatattatcgtatacaactctatcttttgttgaatctaagttcttatatttattattttcaatgttattaactgaaatgttaaaaaaagcacttgtagttttttggtcatcatttacaaaacttctaagtaaaatttggtccatatacataaaagtataattgaaattaagaacggtttcacgaaatagttctatttctgaatctgaattaatattactgacgttattatatttatagccatataaaagaaaaataacaaaaataattacaaaaggaagaaaaattaagtttgctgtcatagaaaaaataatacgaaattcagatatctgcttaaatttatccataaaggaattcttttcatatagattattcccatttatttcgttaaaaagatgactttttaaaactaatataatactaatgtcgtataaaatactggtgatacttattactactacggtcgaccaccatactatattatatttaactatatcattttttgtattggagacgatatcgctattaacttgtttttttaagttgattggattattcatgaaataagtatacataccaaaaaattttattgaattatatataatgcaaaaaaaatagattattttaatttttttagaattgttggttactacttttgttctaattagtggataccaatcccctacaatttcacctgataaccaaaatatatgagcaatagcattacttatataccaatttttctgtgaaaaaggccaataggtatagggttcaaatgttcttaattgcatagtatttcttagtagatctcctgtagaacgtaaaaaccaatgaacaattaaaacaagattaattggcctataccaattttttccatttaatattaatattaaaaatatccatggaaaatgcatattaattaagtaggcatcaattacatattgtagtgcatcagatgtttgaaattttatatcaggatacatgttatgagaattactttcattaaaaaagaaagtaccatcgttaaagacaataccattaaaagttccttcagctaaatttataagcttttgcatttttttctttttcttttttttttttttttattnttntttttataaaaaaagtaaaaaaaaaatagagaaaaaattatattaaagatttaacaaaaatatcaaaatgaaaaacaaaagcaacaaaacaaaaagcaaaaataataataataataataaaatgaaaagcaaaaaaaagcataaaaaaaagtatcttttaattataattatatataatataatttatttaatatatattgatttatttatttactttttttctgataaaaaattataaatatttatatatgttattttttcattattattattttttttttttttacaattttctaaaagaaatgagaatattaataataataatttaaaacaagtatattaatccaaattgtattaatctatggaaaattttctagagcattaattataaatcataaatcatattatttctattgaaatttgtgattttctaaaaaaggtttattaaaaaatagatttattaaaacttaaattttatttattttatattaattatggaaaataggaaaatacttattaattaattaattaattaattacacatataatacatataataaattttattatatatattatttattatatttagtttattatgttagtattttcatttttaaagtaataaatctatatatataaaaattaaaaattaaataaatagtgaaatagttcatttaaatatagaattttaattggtttatttattatttaaaaaactattacaaatattattaaaaatgttaatttatggaaatataatttatttttatttttttttccatttttatttttcttttttattctattttaatttattttttntttttttttttttttcnnttnntttctntnatnnatannnatanaaatantnatattgtttttntaaatatatatattaatatantntattnntattaataataantatanttattaatatnatcnnatnntntntannnntnatcnataactatannanaataaaatattaaaataaaatnatananattttattattannatgttttagtttatnagtataantntaaantnnnanaananaantnnacantataaatnataatnaananaaataaaaacnaaaanaaaanaaaaaaatananataataatatnanatnaanatttatntatntatnnaattnctaantcttantantttaaanttaattanaaaaaaatatatatatatatatnntntnattttttnttntnnnaanaanaannnaaaatnnttnaaaaaaanntttttttttattattattnntttttanatttntntnntnttntatnttntatntanatntaantntntananannttataatttttttttatttttttatnnntnattatcantattanatanaaatattnaaanatttnaaatnnntatttttnttttaanntnnntttaattttaaananaanataanaaaanttanaatnatnttaaaaatanatanaaanaaatataaaanaanaaaatanttatanntantaatttntnntttaaaattaanacnaatatantatnattanatataagatnntncnatttnattntttntnttntanntttatntaaananaatnattanttnnaattatantnatttttaataantntnaannnttttaaaannatnntnaanttantnttanaaanatataattattttttntttatnattngatattnataatatatanatattnttttaaaatttnntttttnttnantaaaantnaaaaaaanntaattttnnttntttttatnnnantttntnaaaanaanattanaaaaatntatattnanannattaanntgtananaattgaatantnntttanntnttnataataatatanaannaaaaantncnatntanttntgttgngntttattnattaaatttattnaantntnnttnattnntttntttatttntttttattantnannttnnntatatttaaan

SEQ ID NO: 1679 - DNA, 4000 bp, Escherichia coli
  misc_feature (1986)..(1987): n is a, c, g, or t
  misc_feature (1991)..(1992): n is a, c, g, or t
  misc_feature (1995)..(1995): n is a, c, g, or t
  misc_feature (3307)..(3307): n is a, c, g, or t
tgaactttgatttttttaattttgggtaaacctacaatcatcattcctgctggaattaataccaatgaaagaaccatggctaccaaaacaccaaatgctgtgaaaacaccgaaatatttaattggatatacttgagatgtcaataatgaaataaatccaacagccgttgtaacagatgtcatggtcaccggcttccacatttcttgaatcatatttttaatggtatcaatttttgatgcagtaggattttcaactctaaataaatccacatgactgaataaatgaattccatctgcaacaccaatagcaatgagcatcactgggatcgttgtgaaaactgcataaattgggatgcccacaacagccaataatccaaatgtccaaatggtgctaaatgatacaaccagcatggttaaaattgtatttttcacacttcgaagtaataccaacaaaataacaataataactgtaagcacaatgggaaccattcgtttcatatctgctggacctaaaaccgccatagttccttccacaatgggccgaccagcaacatggattttttcttccccttcataggaatgggctaattcaagaatttcattatagaattcctgtgtaaatacatcatcattaatgcgagcaattatgacagtaactgtttcattgtctgaaacaagccgaccataaaccatttcattggaacgcactttttgttgaagctcatccaatttatcttgcgtttttgggatgcgtttatagaatgctttcacatccattccatcttccgttccaacaatattgtcagccgtatataatgacgttacatcttgcttttcaatctcatccatcttttgcaaatctttggtgagttgtttgatttttgtcaaagtgcctgtatcataaattccatttggattttccacagcaatgataattccatctttaatatcaaaccattcggccgcttgatcgctataaataaaggcaggatgatcttggggcatgtatttatctaaatccgtttccatccgtgtattatctttcatggcggacacgaagaagaccgtgataccaataaagataattatgaccaatgcgggtcgttttaatatgttttcaagtaagttaagcatggtttctcctttgattagttaatatttactaacattattgtgtaaaattttttagacttttagcaccttttctatagcatcaagcatttcatttacatcttttttcagatcaaaatcaaaattcataatatgccatttactcactaaaaatcgaaaactgccaatgaccattagtgatatttgctctgctttaatatctactcggacatcaccacttgcttgacctttttcaatcatagcaatcaatttattctgatttaatttcatcatgattcgaatgggttttgctagaatactattattattgaatatttcttctgaaaaaataatggctgttaaagatggattcttaataaatcgatttgtatgcccttgtatcatttttttaattttttcgatggtaggattattatcatctatttgggataattctttatttgttgactctttcatggttgatataatcgcaagaataatttcattcttactatcaaaatggcgataaatagccggttcagtaattccaatggcatttgaaatattctttatggtcaatccttgaatccctttttccgcaatcaattggattgattcctgaataatttggttttgtctctcggtgtaattgttcattcgtttatgtcaatgttatgtttgttagtattcactaacggatattataaatagacattttgatatgcaagctttttttctatttgtaatttttggaataaataagagtcattaaatcttctttagaataactatgtaggtcaatgaaacagcacaaactctcacctatcttaatcattatttctctgctattaattggactgtcatgctacagtccaannaatnncanaggaaaagatattgatgaaacattaacgaattggccccaaacaaattctaatttcattaatattaaattgcacatctttaatacggggatgaataaagtatcaccactattggttggaagccccgccccgtggcgacccgcacctgcttttttaattgagcatcctattcatggacttatttgatttaggcttacccgcagagattgctgaatcagcagaacgagtgcttcacccaattacacgaagattattttctacacgttcgttacctaataaaagtatttccaatcaactttcaaaagcaggattttcattagatagtgtaaaatatatttttctctcacatttacattttgaccatataggagatcttaatgaatttaaggatgccacaatagtgattggtgaagataccgatttagatcatttatcgaaattggatggatttgaccctgagcccattcatgatttgaacaaattaaatcttattcaaacactttcatttcacagaggaacccctttggcaaccttcgaaaaagctatcgattattttaaggatggaagtatccaaattattaaaggcggtggacatgttgatggaagcattgctttattaattcaattgcaagatggccccgttttactcagtggggatgaagtggttcactttgattggttaaatcatgatgatgttcaacgcatttctaaaaatccaaatcgaatcgcagacatacggaatcggattcgtatgttaattcaattagcgccagaagtagttctcattccaggacacgatttatcaaaacttcctttaaatcgaaatgatattatttaccataatctagactattttacacaagagttatggccgactaattaattgggctaataaatcaatttttcaaaaaagcgagtgatgattcagcaaattctctgaaactggtcggtgttgttctttcttttgaccttagatgttcaggaattaaaataccatcattataagctttatacatattaattaaatcatcggtataattttcagaagcaccgcggtattgaataatggcattttttgtatcttcataagaagattctatatatttcaattctggtcgatttaatacttctgccatgatggatgttgcttcaaggcaggtaatggattcataccctagtaattctttcacacccggttcttgttttttggttaatgcagaaacaacatttgctgcaatatcctttgtagccgtcatatttaaaggtaaatctgcttttattggcgatgaccaaaaattcatattttgaatggtnccggcgctaaataatacattttccataaaataatcaggtcgaaaaatgtgaagattaacatcggttagtgtcgccaatcgctgttcatgttcataatgtccagaaatatgactatcattatcaggaatatgggcaccaatactactcaaaatagcgactctatttattccggaatttctaattgcagttgtttgggcttgactcgtttgccgcataaactctcgaacattgggtgcagataaatctgggggaataagcgtaaatgctccatcgaccccagtaaatgcttcagttaatttttgtgaatcatctaaatgactcacaaagggttctgccccttttgatgtaatggattctaatgattctaaacttcgactgacggctcgaacctcgtgcccaagacctatgagtgattgcgtaatttgtgagccaatctgtcctgtggcgccaaggagagtgaatttcataataaggaattattcctttgtgaattcttttgctaagtcttccacggcttcattcatatccggcgcagtttctaacgattctcgatcctgttgaatgattcgcataatgcgtgctaaatattctgcatgccaaagctgtctttcttgcgcgtcttgttcagatggaagaaatgattcaatttcattgcgactcattatgcctttggattctaaaattcgctctaaa

SEQ ID NO: 1680 - DNA, 4000 bp, Escherichia coli
  misc_feature (92)..(92): n is a, c, g, or t
cggagcagggcgtcgcggatctgcgcggaaagtgcccgcgcgagcgtgcgctcgagatcatcaacaactgtgcacatccggactaccgtccncttctgctcgactactacaatcgtgcactcgaggccacgaagggcgcacagacaccgcatctcctggacgaggcgctttccttccaccagcgtttcgtaaagacggggacgatgcagaaataacatagacaaaaagggcataaaagccctttagggcccaaaaaggacccaacaagaactgttaaggtaaaggagaatactttcatgagcaatgaaaagatccaggcggggcttgacaagtacaacgccaccgtagagaaggcagcagcgaagttcccaatgcgtcaaagcattcctgagcagggcctttacaccccgctcgacatcaaggacacggactatgcagaggacatcggtttccccggtgtttatccctacacccgaggcgttcagccgacgatgtaccgcgggcgtttctggacgatgcgtatgtacgcaggtttctccacggcggaggagtccaacaagcgctatcgttacctcatcgagagcggcgcaacgggcctttcctgcgcatttgacctcccgacgcagatcggctatgactcgaccgaccccatctctgagggcgaggtcggcaaggtcggtgttgcgatcgactcccttgctgatatggagatcctctttgatcagatcgacctcggcaaggtttccacgtccatgacgatcaacgctccggcgtccgtcctcctcgcgatgtacatcgcggttgcggagaagcagggcgtctcggcggataagctcaagggcacgatccagaacgacattctgaaggagtatgcggcacgcggcacttacattttcccgccgcgcccgtccatgcgcctgatcacgaacatttttgaatattgctccaagaacgtcccgaactggaacacgatttccatctcgggctaccacatccgcgaggctggttccacagcatcgcaggaaattgcattcaccattgcagacggcatcgcttacgtcgaggctgccattaaggccggcctcaacgttgacgactttgcaggacgtctctccttcttctggaacgcacacaacaatgttctcgaggaagttgcgaagttccgcgcatcccgccgcatctgggccaaggtcatgaaggatcgtttcaaggccgagaaagcaaaatcccagatgctccgcgttcacacgcagacggcaggctcgatgctcaccgcacagcagccgaacaacaacatcgtccgcgttgcgctccagaccgcagcagcagtcatgggcggcacgcagtcgctgcacacgaactcccgcgatgaagcgcttgcgcttccgacggaggattcggttatggtcgcacttcgtacgcagcagatcgttgcgtatgagagcggtcttgccgatgtgattgacccgctcgcaggttcctactacgtcgaggcgatgaccaaccgcatcgaggcagaggcctgggagtacatcaagaagattgatgagctcggcggcgctgttgcggcgatcgagaagggctacatccagaaggagattcaggacagcgcctacaagtggcagatggatgttgagtccggcgcccgcgttatcgtcggcgtcaacaagttccaggtggaggaagaggctccgaagaacctcctccgcgtggatgcttccgtcggcgagaagcagaaggctaaggtcgaggcgatgaaggcaaagcgcgacaacgcagccgttcaggcggctctggctgacctcaaaaaggcatgcgcggacgagcacgaaaacctcatgccgcatatccttgcagcggtcaagacctatgctacgctcggcgaaatctgcggtgttatgcgtgaagtcttcggcgagtacgaggcacacgtcaacctgtaagaagcggttgtttggtgaatacacatggggcagcgccgcggtgcggcgccggctcccttcaggaggaatataaaaatggcagataaaatcagagtgctcgttgcaaaaccgggtctggatggtcatgatcgcggcgctaaggtcgttgcgcgcgcactgcgcgacgccggctttgaggtcgtttacacgggactccgtcagacccctgaggagatcgctgaggcggctctccaggaggacgtcaacgttgttgcaatgagcatcctctccggtgcgcatccgcacctcttcccgacggtcgtgaacctcgttcgcgagaagggaatgaaggatgtgctgatcatcggcggcggcgttatccccgagggcgatatccccgccctcaagaaggcaggtgttgccgaggtcttcacgccgggcacgccgaccagcgcgattgttgatttcatcaaggcaaacgttaaggcgtaacagcgccttttgaaaggatggatgacagacagaaaatgcttcagtctgtcatccattcccttgtttcttatggagtcactgcgctgaggaggtgggcatatggatattgcagcagaggtgctgaagggcaaccgcctcgcactctcacgcgccatcacggcgattgagaacgagcgcgagaatgctgtcgacatcatgaaagcgctctatccgcatacgggaaatgcctacgtacttggcattaccggccccccgggtgcgggcaaaagcaccatgacggataagattgccaaggaataccgcaaacgcgggaaaacggtcggcatcatcgccgtcgaccctacgagccccttttccggcggcgctattctaggcgaccgcatccgtatgaacgacctgacgctcgacgagggcgtttttatccgcagcatgggtacgcgcggcagcctcggcggcctctcgcacaagactgctgacgcggtaaaggtcatggatgctttcggcaaggacgttatctttgtcgagaccgttggtgtcgggcagtccgaggtggatatcgtacgggcggcggacactacgatggttgtgctgattccgggcatgggcgacgatattcaggccatcaaggcgggaatcttggagatcggcgatgtattcgccatcaacaagtccgatcttgacggtgcggataaactcgtccgtgagatcaatatgatgctggatctggatgaccatatgtccgactggcgtccgcccatccgtaaggtcgtcgcgaatcgcggcgaagggattgcggagctggttgacaccgttgaagaacaccgtgcccatattgagggcaatggggttctcacagagcggcgtacgcgccgcacacgcgatgagatgctggatatcctgcatgcaggtgtccggcgcagcatcgaaggccgcattatcaatacggggcgactcgacgactatgtggcaaagatcaaggcgcatgagaccgacccctatacggtggtcggcgagatcatggccgaaatgttggcatgaggaaatactgacggcggatgcccctccagaggaggatgaccgcatcagacattcctcgactcagctaggaggaagtatcatgttcaaggttctgggagtggatcacatcggcgttgccgttaaggatctcgaagagggaaagaatttctggtctgatgttatcggcattgcctgcacgaaccaggagacggttgctgagcagaaagtcacgacgaccttccatccgacgccgaacggcagcgagattgagctgctcatcggcacggcgccggacagccccatcacgaagtacattgagaagaacggcgagggcattcagcacgttgcgctgcgcgtcgacaacatcgagaacgcgatcgccgatctcatggcgaagggcgtccgcatgatcgatgagaagccgcgtatcggcgcgggcggcgcgaagatcgcatttcttcatccgaaatcgacgaagggcgttctcctcgaaatctgtgaacatgaggatcgctgaggagcggcgtttacccgaaacacattgcaaaggagcttcgcactctgcgatg

SEQ ID NO: 1681 - DNA, 4000 bp, Escherichia coli
  misc_feature (1935)..(1935): n is a, c, g, or t
  misc_feature (1992)..(1992): n is a, c, g, or t
agagcttgtgtatgaggtgtaaaaccttcaacagtactatgtaaccactttgaagctgtctgaacattatctgctccagcaaaaagctctgaaggcagaccataaattacctggaaatatccagaaacatacggttgatttgaacgccaatgtccaccaatgtccctggttagaaaatccggcttttctcgatctttaatggcattagtaaaccgagtcgagagtctactaatgatggttgttgcatctgccatgttatactccttaaaaataatttttggatcggcaagacctagttaaaggtcttgccggattcatttttgttagtggacaatgatgaacacattaattctttcaatggcgcggataggcgtcacatcgataataacatttaattctgacgcgacatcgtcgaaacttaccgcaacattaaaactcttaagaactgaatatctttcaacactcgattctaagaatttacttaagaaattagcaaccctaaactgggcttgaccaatccagtactgagttgcccttctctgtagaatgtcctttaacagagtaggaatgactttccgaatatatgcaataaattttgcaacatgtaaacgtttcagaactgacaatctcttccatgtagtaaactgagtaagaatgtatttgccctgaggttcaacaattatacaatttaattcagcatccatcaaatcgccacgttcagtatgatttgacttataagctaactcaatcggttctgcaatagcgcctttttcaataccggcaactggttctgcgatgaaatatgctccatcacaatatagatgcctctcaagtgcatgatacactggattcatccaaatacgttcaccagtaaaggcatcaaaaatcttccgatactgaacatacaaagctgacgtccaatcattccacggaacatcatttaatcgagctgtcaaatctgcagaatatgtagttaccttagcaccagtatcaccaagatgaatacaatcctgcctataagaagcaagataacgaccaccattctgaacggcagctgaataaccacctgtaataatgtaatctggttgataccaaggatacacacattcaggaatctgttcaatagaaccatcaacactaaccattgcaccttgataagctagtaatatctgtccgtcaagataatctctatctgcttcaagattattagtagaattatacattggaagtgttcgaccagtattaactgttccatctgttccattttcaaattgtacaccacctgcagcaatactaccagttgaagaatcaacagtacttccagaaacggtcatcagtaactgaacctgtaatctcctctttgtagcttgtgtctcagtggttgcaccaactgcaacaagaccatcgacagctgcagcagaaatacagccaacaaaattactattgttattaattgcatcttcaatatataatgaagtaccagatgtaagatctttaattgttgatccaaatgcattacgtcgagttaatgaaacagaccatggaccttccaatagagtagttgtaccatcatcatttagatagtacactccgatatccataaatagatatttatataaaaccactccattagtgtcagtatacatcttttcaagttcgacgttacgaactcccataattttaatattgttgtaatatgttccagcaccttttgcataaaaataccaaaccactgttgaagtaacttcaggcatttgggcctcagaggttacacttgcagtggaaccagcaatatatggtgaacaagaatatccatcaacagctccagaaattgttccagcgtaaacattatcaagtgttaatgttagcgtagcaagatttttagcgacaacctgtcctgcatcagctacagtatcaccgtctgcaaaaatccangttccaacagcaacagcattaaatgaagatgcgttagatgctacaacattcttactncccggagtaaatgtaaaagtagcatcagttggacccggtaaataagtaattttagtacttgaagtcgatgttgaaatatttttatttgcccaatatgcatcatctggcatcgctcgaacaagcaaaagattgctcgagtactgtaaaaatttatctgcaagataatgcgcttgagaagttcttcgataattgggctgtccaaataatttataaaattgttctcttgatgttaacgtgacaaccctattatgtggtccacggtcacaaagagtaacaatatatccaattcttccagtctctagagactcagcagcataagaagcatcctcaatgcttacatatacagctggttcacgacgatctgttaccggcataattcttaactcctttaaataaatttattttaataatctttcaatgccgatctatctgtctttatttaactcataaacaaaattaccacaatcccagattctatcataaccatttaattgcatattttcccattctgtcaatttttcatcaaatagttctaacttattttgcaataaatgtttctgaaattgtaaccttgacaatctttttcgtgtaccacattttacataataatatcctggttcagttgtccccacgaatttaaatccacatttataataaccagttcctatcccatatcttgcatctgcataagttatgatggaattaaatggtgttatggtatcaatagctctcaataatttagacaaagaacctggaacactagtattgtttttattacaaaatctataaatttcaatatcgtgagaggaactaaatcttggagagcctatagtcatcatcgatacgaattcattattataatacaaccctatatgctcaccattgataaatccttgaatgtgattagttgtatagaattgtttagcatcttctattggaactgaatagatttgacactttcttgcaaaaattctgtaatcattctttttaaatttattcaataacacacttttaactatattttgtttatataaccattcatcttcaaaaatttgaactaaattaatttgtttttgcaaagataataataatttgcgctgatgataatctttatcttttctaccaaatacttcagaatgccaataaacaccatttaactcgattcccaatttgatatctggaatgtagatatcgatctcatatggtggaattaaagttctatttctattttcaataatagaatattcttgacaaaactgcacaatctctttttcgacagaagatgtcccaactacaggatagcaggttggacatctaggcaaattaccattatcaatatcgtcatcaaaagtggtattacattttaaacatttccaaagatattttttattatgtttgacaccagaataatcagaaattgaaaacaatggtaaatatctttcttttaatctattactcgagagcaacttttcaaaaaaatgatatttttgtgtttgtgaaattttttgttgaatttctttgttcttcgctggattatcaactccatactttttcaaatgagtctggcgaataacatcttgaatcactggatcttgtagagaacaatcatatcctgttttattccgatacgtttctgctctttttttaataactacatgattgaaacttggattttcaaaacctgttttgctcatatatgtgttttttatcttctcttttacatcaggattttgaaatgggtgattgtaccccgttttttcaaaatattttttctgtcgaatcgtattgattccaggaatataattaatatgagaatatccaaagtgttcaaatgttgtttcaattttcttattctttatctctgggtcttgagaaggatttttgtaaccagttttctcaaaataagtagtaaaagcttttgtattaatatatttttgatcatcaattcggcaaccaatcgaacaatatgtttgataaccttttgaaaactgttttgtaaattcagttg

SEQ ID NO: 1682 - DNA, 4000 bp, Escherichia coli
  misc_feature (219)..(219): n is a, c, g, or t
  misc_feature (2814)..(2814): n is a, c, g, or t
  misc_feature (2830)..(2830): n is a, c, g, or t
  misc_feature (2910)..(2910): n is a, c, g, or t
  misc_feature (2933)..(2933): n is a, c, g, or t
  misc_feature (2975)..(2975): n is a, c, g, or t
  misc_feature (2989)..(2989): n is a, c, g, or t
  misc_feature (3117)..(3117): n is a, c, g, or t
  misc_feature (3120)..(3120): n is a, c, g, or t
  misc_feature (3137)..(3137): n is a, c, g, or t
  misc_feature (3468)..(3468): n is a, c, g, or t
  misc_feature (3828)..(3828): n is a, c, g, or t
  misc_feature (3863)..(3863): n is a, c, g, or t
  misc_feature (3867)..(3867): n is a, c, g, or t
  misc_feature (3902)..(3902): n is a, c, g, or t
  misc_feature (3942)..(3942): n is a, c, g, or t
  misc_feature (3998)..(3998): n is a, c, g, or t
catggcttgctaggccacgaccggtgtagcgaagttcatcacgtaccagttgttccaggttgtcaggcaggccaatgcgcgcgacctgctttttcgtttgctgtgcagcaagcggagcgatagcggcaattcggtggcaataatcttcaaaaaaccaggtgaattgtgcgtcggcaaccacctcgccaaccaagccgatttccagcgccctggttgctntaacaaattcaatctccagcagaaaacgcattgcctgctcgtgtcccaacgcctgtggcagcgtccaagtgagaccacaatcaggagaagtacccactctggcgtaacccgggtggaaggttgctttgtcgctagcaatacgcatgtcacaacacatcgcaagagacagtcctgcaccaatagcgagaccgttgaccccgcaaaccactggcttttcacaatcgatgcgtatgcctgtgacgagcctcaccacgcgctcgattgtgttagccgcactgtcactttgacggctattctttggtctgctcaaatccgcacctgcgcaaaaagtgtcgccgttacctgtgatgccgataacgcgcacggagtcatctttagtcgcctgttcaacagcttccactatgaggcttgtcaactctcccgacagggcgttttttttctcaggtcgattgaggcggaggattaacacatgatcttgttgctctttcaggagcgcaggttcgctcattggtttgcaccttgcattttcaaattcctattcgcttgttaagctcgacggtgttgtcgtgtagtattttttgttgcgttgtaagcgtgagatcttcaatctcgtcgagaatgtccagcggtctctcaagaccctccatgtgcggccagtcagaaccgacaatgaccctgtcctcacccatgtggtcaatcacttcacgaatgtcatcttcccagaacgggttgatccagacgtgctctttgaatgattcgattggatgtagccgatagtatgtcggtgttcgctcggcactatgctcaaatgccctcaacatttcagggaggaattcggaaccattttccactgaagcgatgcgtacattggggaatctctcaaatagtttgtcgaacaccaggcttgcgaggaaatccataatattgcgcggccgatgaaagtttgtaacgctgggttttgcacccatcgaaagcacatcctggtttttgacgtcatagccgttgctgtcatgacgcgtctgcccaatgtgcacaacgacagtgatacccgcttcgttgacccttgaccagaatgggtcgaataccttgtgtccaggattacgtggcccttctttagtaaagaccgcgctgggtcgcatgacgagtatacgggcgtctttcttcagagccttctcgagctcttcgcacgcatgattaacacttgcaagactgatataaggcgcagaaaacaaccgattctcatagttaaaaccccagtcttcatccagccattggttgaacgcactgtataaagtacatactgcatccacgtctttttttagcagttcctcgtagagaatggccagcgtcggaaacaaccatgcggcctcaagaccttgcgcatttagcctggcgatgcgggcatcccgatccatatattcaggcggcatgggttcgagtgaggagcgactcaactcggcactggttgcgttgttggggttgccgcgaaatagttctcgtagcacacctggttttgaaactgggttgaaggttgggttagtgaaccgatcgactttaccggcgatagagtggtactgcctgctgtcttccatcgtcacccattgtacgcaccgcggctgcatatgttttggcacatgacgagtaaaagcgtcccgaccttcgtaatagtggttgtctgcatcaaacagcaggccgttaaatctgggcactaatgcctccctatcaaagtcaaattcagcttaactatgattctaataataatagaaattccaaataaattgcaaaaaacctgcaaatatgcatattatttcacttaatagtatactaattaagagtttatatatcgagaggaagaccatgttaaatgagattaccgtccgtaaaatgccatttgagttcccctctgatatcgatgctgtattcgttgaaggcgaccacaaacgttcattcaattttattgcgggttcactgttactaccccacttagagccgtatcttattaggtcaatgaaagcagcagaaaaatatgtgacggatcctgttgttgcggaggggttggacaaatttgtgcgtcaggaggctcagcattaccagatgcacaaaaaattcaatgatactgttagactcgctggcttccccgaactggcatcttttgagaaagagctgtctgatgattaccaccggtttaccaataccaaatcattgaaattcaatctggcttatgccgagggtttcgaagcgctgacaatgaatgcggtcaaacacatgatggagccgaacggttttggtgaagatctaccaccatttatgcaaatggttgaatggcattttgtggaagaacttgagcaccgcacggtcaccttcgatgtctatgagcacgttttcggagattatctgtatcgtctatttgtaggtgtctgggcccagtggcactttagtaattggatgcgtcgcgtggccgcatacatgctggaagtaaggcctcagcaaaaaatagataaaacaatcgatcgagaagaaaaacttgccagagtccagccggccagcgttggcaatctactgccaggtttgttgcgcatctacctgccaaattanacgccgcacgatgttnaaatatcccctggcatccagcagcttgctgacaagtacacgaacatggcactggaaacctcttgaatgcaaagagccccnaacctgactcttttggcgacggncaaactagctaagaccgctcaaccaaggctaggtaaatctanaaattgaagccacntctgagccgcaaattcaacggctcatgaatttaaggcgtcagcagagcaatgctggcagcctattcttcgtctgttaatagaagatttaaacactggtgttaataacgatttacataaatttgcaaanganatcgtgggtaatcaggngtaatttggcttcctatttaataactatttttctcgccctctggcgcgtttctgcacctacgcaaaagaacaggtgagttacttagcatcaagcgccaataacaagcggcccgcttcctttattgataacagcgcctgctgccttttgtgagactcactggcgggctcaagcccccacaagttcatgtatttttgagcggctgcggcgacgtagatctgccacagcgcaagccgttcaacatctatggctctatatttggcataggctgcagaaaaacgggtcattgctggcgcaccaaagagataacgaagctctaccctcgcaatagcnacatccgatagcgggtcgcctactgctgcatcttcccaatcgagaacggcagcaattgcgccatgttgccaaagtatattctcaggccaaaagtctccatgcaacaaggtcacttctcctgaaaattgtttcacttttcgcgcactcagatattggctcagaccctcccattcctcccctttcggcagatagtcgagcagttcagggagcggctctgtacgcagactaacatccggtaacgttggcacatttgcctggtgaatcgatgccaaggtagctgccatcgcatcgatataatgagatttttcgccctcgggaattcttgtactgccgccaataaaagcaatgatcacgtaaggntagctaagcacggtgcagctcgtgtcaaaagccantggncgaggcacactgacgcccgatacatagagtgattntaaaatatcatgctccatctctgcgggatgtccagagtgntttttaccgtgctcgcgaatcacaacacttcgctcgttcccatctctatccatcanat

SEQ ID NO: 1683 - DNA, 4000 bp, Escherichia coli
  misc_feature (1)..(80): n is a, c, g, or t
  misc_feature (82)..(181): n is a, c, g, or t
  misc_feature (183)..(406): n is a, c, g, or t
  misc_feature (408)..(453): n is a, c, g, or t
  misc_feature (455)..(519): n is a, c, g, or t
  misc_feature (521)..(660): n is a, c, g, or t
  misc_feature (662)..(761): n is a, c, g, or t
  misc_feature (763)..(777): n is a, c, g, or t
  misc_feature (779)..(853): n is a, c, g, or t
  misc_feature (855)..(1073): n is a, c, g, or t
  misc_feature (1075)..(1344): n is a, c, g, or t
  misc_feature (1346)..(1426): n is a, c, g, or t
  misc_feature (1428)..(1435): n is a, c, g, or t
  misc_feature (1437)..(1484): n is a, c, g, or t
  misc_feature (1486)..(1491): n is a, c, g, or t
  misc_feature (1495)..(1495): n is a, c, g, or t
  misc_feature (1498)..(1499): n is a, c, g, or t
  misc_feature (1501)..(1505): n is a, c, g, or t
  misc_feature (1508)..(1508): n is a, c, g, or t
  misc_feature (1512)..(1514): n is a, c, g, or t
  misc_feature (1516)..(1517): n is a, c, g, or t
  misc_feature (1519)..(1519): n is a, c, g, or t
  misc_feature (1523)..(1525): n is a, c, g, or t
  misc_feature (1527)..(1528): n is a, c, g, or t
  misc_feature (1531)..(1531): n is a, c, g, or t
  misc_feature (1535)..(1535): n is a, c, g, or t
  misc_feature (1537)..(1545): n is a, c, g, or t
  misc_feature (1547)..(1548): n is a, c, g, or t
  misc_feature (1553)..(1554): n is a, c, g, or t
  misc_feature (1556)..(1559): n is a, c, g, or t
  misc_feature (1561)..(1563): n is a, c, g, or t
  misc_feature (1565)..(1569): n is a, c, g, or t
  misc_feature (1574)..(1574): n is a, c, g, or t
  misc_feature (1576)..(1589): n is a, c, g, or t
  misc_feature (1591)..(1597): n is a, c, g, or t
  misc_feature (1599)..(1599): n is a, c, g, or t
  misc_feature (1601)..(1607): n is a, c, g, or t
  misc_feature (1609)..(1617): n is a, c, g, or t
  misc_feature (1620)..(1621): n is a, c, g, or t
  misc_feature (1623)..(1629): n is a, c, g, or t
  misc_feature (1631)..(1643): n is a, c, g, or t
  misc_feature (1645)..(1645): n is a, c, g, or t
  misc_feature (1647)..(1651): n is a, c, g, or t
  misc_feature (1653)..(1653): n is a, c, g, or t
  misc_feature (1655)..(1662): n is a, c, g, or t
  misc_feature (1664)..(1665): n is a, c, g, or t
  misc_feature (1667)..(1667): n is a, c, g, or t
  misc_feature (1669)..(1673): n is a, c, g, or t
  misc_feature (1675)..(1675): n is a, c, g, or t
  misc_feature (1677)..(1687): n is a, c, g, or t
  misc_feature (1689)..(1689): n is a, c, g, or t
  misc_feature (1691)..(1695): n is a, c, g, or t
  misc_feature (1700)..(1708): n is a, c, g, or t
  misc_feature (1710)..(1710): n is a, c, g, or t
  misc_feature (1712)..(1716): n is a, c, g, or t
  misc_feature (1720)..(1720): n is a, c, g, or t
  misc_feature (1722)..(1729): n is a, c, g, or t
  misc_feature (1731)..(1731): n is a, c, g, or t
  misc_feature (1733)..(1733): n is a, c, g, or t
  misc_feature (1735)..(1735): n is a, c, g, or t
  misc_feature (1737)..(1741): n is a, c, g, or t
  misc_feature (1744)..(1747): n is a, c, g, or t
  misc_feature (1749)..(1752): n is a, c, g, or t
  misc_feature (1755)..(1761): n is a, c, g, or t
  misc_feature (1764)..(1769): n is a, c, g, or t
  misc_feature (1774)..(1774): n is a, c, g, or t
  misc_feature (1780)..(1781): n is a, c, g, or t
  misc_feature (1783)..(1783): n is a, c, g, or t
  misc_feature (1785)..(1785): n is a, c, g, or t
  misc_feature (1788)..(1788): n is a, c, g, or t
  misc_feature (1791)..(1791): n is a, c, g, or t
  misc_feature (1794)..(1798): n is a, c, g, or t
  misc_feature (1804)..(1805): n is a, c, g, or t
  misc_feature (1807)..(1807): n is a, c, g, or t
  misc_feature (1811)..(1811): n is a, c, g, or t
  misc_feature (1817)..(1817): n is a, c, g, or t
  misc_feature (1821)..(1821): n is a, c, g, or t
  misc_feature (1833)..(1833): n is a, c, g, or t
  misc_feature (1835)..(1835): n is a, c, g, or t
  misc_feature (1841)..(1841): n is a, c, g, or t
  misc_feature (1844)..(1844): n is a, c, g, or t
  misc_feature (1846)..(1846): n is a, c, g, or t
  misc_feature (1849)..(1849): n is a, c, g, or t
  misc_feature (1851)..(1852): n is a, c, g, or t
  misc_feature (1876)..(1876): n is a, c, g, or t
  misc_feature (1921)..(1921): n is a, c, g, or t
  misc_feature (1980)..(1980): n is a, c, g, or t
  misc_feature (1985)..(1985): n is a, c, g, or t
  misc_feature (1993)..(1993): n is a, c, g, or t
  misc_feature (2019)..(2019): n is a, c, g, or t
  misc_feature (2023)..(2023): n is a, c, g, or t
  misc_feature (2259)..(2259): n is a, c, g, or t
  misc_feature (2283)..(2283): n is a, c, g, or t
  misc_feature (3894)..(3894): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnncnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnntnnnnnnnnannnnnnnnnnnnnnnnnnnnnnnnnnnnnnnnnnnnnnnnnnnnnnnnannnnnncccnccnncnnnnnccncccnnncnnangggnnngnnggnaaangnnnnnnnnnannccccnncnnnncnnncnnnnnccccncnnnnnnnnnnnnnngnnnnnnnancnnnnnnngnnnnnnnnnccnncnnnnnnngnnnnnnnnnnnnncnannnnngntnnnnnnnngnncnannnnngntnnnnnnnnnnncnannnnnggttnnnnnnnnntncnnnnnttgntnnnnnnnngnancnannnnnggnnnnannnnaannnnnnnttnnnnnnccccncccccnntntnccnccnccnnnnngccccnnanaaancccccnttcngcagtgcatctnanagagangcncngcngnnggaaaaagcaaccagtactggtcngcatcgtgaccagtactggtaagtggtggtgaccagtactgcttnctgaagtgaccagtactgatccgatcggcgaccagtactggtcacttttgcccctcccnagagntgctctanctcagcccgccaggaaggagagcaanatgngcgaaagcaaaagtgcccgctgcgaccgaagtcacagcgggcactcgccgatagaatatcgaaggggggagagctactattctgcgctttcagcagcaggagcttcagccgtagccttcgtagagcggcgtgaacgacgcgtcttaggagcagccttcttgtcagccttttccttgagcatgttctcgttgaagtctacgagctcgatgaagcagacagcagcgttgtcaccgagncggttacccgtcttgaggatacgngtgtagccaccgggacggtcagcgatcttttcagcaacggggccgaagagttccttgacagcaaacttattctgcagctcagcgaagacgatacgacgtgcgtgcgtggagtcttccttagcgcgggtcagcaggggctcgacgtatacgcgaagagccttagccttagcgaccgtggtgaagatgcgcttgtgcaggatgagcgatgcagccatgttggaaagcatagcctcgcggtgcgccttcttacgaccgagatgattgaatttcttattatgtctcatctttctacttagtcattatctaaattgtacttgctaacatccatcccgaaggtgagtccgagtcgctccatcagctcgttgagctcgtccatagacttcttaccgaagttgcggaacttgctgagcgtatcagcgtcgaggacgacgaggtcggccagacggaatacgttgccggagcggaggcagttctgcgcacggacggagagatcgagatccttgagatcagtacggagcagctgagatacgcgatcgatctcctgcatgtccagtacctcctcgtcgccttcctcgatgactgcattctcttctacctcgacagggtcagagatgaagaggctgaagtgctcgatgaggatagctgctgcgtccttgagagcctgctggggatgaatgctcccgtcagtggtgatctcgagggtcagcttctcgtagtcagtcttctgctctacacgatagttctccgtgaagtacttgacattacggataggcgtatagatcgagtcgatagcgatcgtctgcagctcattctcctgagccgtgtcgaccagcttctcatcagcggggatgtaaccacgccccttgttgatggagagctcgatagtaagggtatacgcctcatcgatgtggcagatgaccagctcgggattgaggacttcgaaggaagtaagcttgccgttgagctcgccagcgaggaactgctgctgaccagagatcgtcaggctgacggtctcctcagtagcgtcctggacgagggcacggaagcggacttgcttcaggttgagaatgatgttagttacatcctccaagacacccggaatagtagcaaattcatgattgacaccttcgatcttgatggtcgagatggcgtagccttcgagtgaagaaaggagtatacgacgcagggcattaccgacagtggtaccatatcccggctcaagagggcggaactcgaacttagcgtacgagtccgtcgcatccatcatgaggacgttttcgggcttctgaaatgctaatattgccatgtgagtgagataatagggattattacttagagtatagttcgacgatcagctgctccttgatctcttcggggatgtcttcacgctgaggagcgctgaggaacttaccggagagagaagcctgattccactcgagccagctgtagctgctgtggctacgaccagccagagagtcggtgatgacctctaagctcttcgccttctcacggacgccgacgacctggccgggcttgagggtgtaagaagggatgttgactacctgaccatcgacggtgatgtgacggtgcgagacgagctgacgagcagcngcacgcgtcttagcgatgccgaggcgatagacgacgttgtcgaggcggctttccaggagctggaggagcacttcacccgtgacacccttcgtgcgctgagcctttt

SEQ ID NO: 1684 - DNA, 4000 bp, Escherichia coli
  misc_feature (1984)..(1984): n is a, c, g, or t
  misc_feature (1994)..(1994): n is a, c, g, or t
ttccttgtaggctctttaccgtattcattactgaattataggcacccaccaacgaattgatcttagtctttaacgcatcgttgtctttcgatacatcaaggttaattgtggcgccagctgaatccttttttaagttaatcgtcacacctgctataacatcggtgatggtattcgatgatttcgtcactgccaacccatcaacttcaagggaggcgtccttcggtattagcgattgcgataagcttgcgattccaccgttaacaagcccagtggcaccatcgtaggtgggattaaatgcgagttttgacaaaccggtcatgtcctggtcatcggggttctcctcaaatgtgccatcgttatcttcatcaacttttataacgatcttgtttgcgagacccgttttgttagaagccaggactaatctattccccgatccatcgttcactatagatgcggtaacatctgtcttggctgtattgatagcgtccttgatgcccgcaagagtattgttcgttgaatcgaccgttattgcaaaggcaatgccactgccgacctgaatctgcaacttctgtgtagcatacgtcgataaatcagctacggaatcggttgtgttggcaaaagttgtagagtagatgctttgggcaaacgctatgttaataactttgatggtgtggccagctgccgtagcacctgcattggtagttgtggtgaagactgctgtatcaccgctagtagccttcatgcttatgctgttactatcctttagcgccgtaacagcactcttgaaactcgagaccgatgataacagattgccgagaccgcttatttttgccgcgtaagcagcctctttcgtttgcaacactgtaagcggctggcgctcaacttgcataagcttgctgacaatatcatcggtgttaatgccggagaaaatccccgaagttgttaatgtcatgttacgcctctttatcgtaattactctttatactatcctgaaggcgctcgtaagcggttattaactccttaggcggaatctgctttaccacttggccttccttatcgagaaactggatgactacgtatttctcatcctggatagcaaaaacagccttgttgtcattaattgcagcccctggctctttttgcttagatactttgacctctggggtttgacccttttgttgggccggctcagagggttgtgcgcttttgattgcagctatattcagttttattagacccgtcggttttacttccatcttatttgaagagagggcggcctatgggccgcccccaattctccctccaattgattactgcctcagtagcgttaatacgttctgtggtaatgtattagcctgagctaataccgagataccagcctgctgcaagatctgcgcttttgttatattcgcagtctcagccgcgaagtcggcatccataatccgtgagtgagcggctgtaatgttctccaaaacgtttgacaggttagccgttgtggattggaacctgttaagaacagcaccaaggtctgctctcatgttcgagataacattaagggccgagtcgattctcttcatcgtgttgttagcgccagtaaccgtcttaacatcgatattgctaagagtctgggcatctttcgtaatcgtagtagcgccagcaccaaagccgagcttattggaagcgtcaccggtgatcttaatgtcgtcgcttgagctgagctcgatgaacccgtgtgtcgtagagtcagcgttaaatgcagcggtagcaccagcagtaacggttacatcaacgccgatatccctaccatcagcagcggtaagctcgatatacgtgccgttaagcgcagcaccaacgccggtctggcttgagtacatgttgatcctatcgatcaactgctgttgggtaagaccctctgttgcaaatgcagcggtagcggtatagttaaacaccgttacaccgttgatatcaagcttgtaagcatcanctgcggctgnaaagtcaatacctttgttggcaacgtttgaggttgtcgtgcccgtaacggcggtagctgttacgcctgaaacaccactcgcattgatagcgtttgctactgaccatgcgctagaggtggtctggccggcgccacctgcaacggtcgcgataattttattatcattgatctggatgttatcgccacctacgatagccacactggtagcagtagttgcagtactatcagcgatctgaccgatctgacctgcctttaagccctgtgcaagcgcaacgctaattgtctggccggcattggcgccaacctggaatgctttgcttcccagcgtaccatcaagcaatgtctggttgttaaactgggtctgcgttgcaatcctatcgacctcagcgacgagctgctgaacctctttgtcggtcgcaccacggtcaagagcggtgttggaagcgttcgctgactggacggctagctctctaatcctctggagagcattggtcatctcatcgatagcaccctcagcggtctgtacaagtgaaaccgcatcgtttgcattacgaacggcctgggtaagacccttcatctgcgagttcatcctcacagcgatagcaagaccagctgcatcgtcttttgctgagttgattctcatacctgaagagagtctctgcatagcagtctggagcggcatgagggtcttgctgaggtttctttgagcattcagggactgaatgttcgtgttgattactaatggcatttttcaattcctccttgagttttcgagtttccgatcttatgatcttcaacccatctgtcttaggcatccttgccttaggtttcttatcatggaaagcctaccttatccggccggtttaagggaaagccttccacaacaaaaatggccttacggtaggtatcgtcaggccattagcttttctgcacaggatttgagaaaattcttaagaattatgggtcttgttttgaaggtttctcgggaagtagttcacctatgttttgaagagccgcttctgaggttgatgcggcaagactgttctcttcgagaatagatttatagatctccgcgcgatgcaccgggatgtcttttggggctttgatcccgatctttacatgatcatctttgatctctactacgaagatttctatatctgttcctatatgtatactctcgttaagtttcctggtaagaaccagcattgcatctcctaatatttatgaaacaattaactaagatctgttgaacaaacggtgcttggtcgtatagtcctcgctagacaagataacctgttttgccgtgttatttctagtgttaatgataaccggcgccttaagattagcagtcatcttcttcggatctttcggaatagtcagtatcgacagcataacccagccttcgtcggagctgtcttcggctcctccggctacctcgagtttctccaggtcaatctcatttacggtcggcttgtaattctcaaaaaacagccatggatcggtcacgacaaatgcaacgtccggtgcgtccacggactgaagccaggcaaagggactatcctctttgtgaggaataaggatgaaccgctccgtttctggaaatccggggatttcatcgacgaaacgaattacgttcgcctcatcgatttcgacttgaccaaacctcgtagtcgtaaattgaatcctctttgtactcgttctttcagcaagttttaccataatgctccggaagcccccgcaggctatacctcgtgcctgtttgcttccttctctcctttgctcgtttaatagtaaccctaacaaagtgcttttaaaacactctagttattggtttaagaacctttacttacataacgctagatagcgctacctcaagaaatcaatgagcgatttttgcagcgccgtgctgccggccattaaagccgcctgatatacgttctcatccatcttgagccttgtgatgacttctgccaaatcggcatcttctacaccgctaagggcttttgt

SEQ ID NO: 1685 - DNA, 4000 bp, Escherichia coli
  misc_feature (1539)..(1539): n is a, c, g, or t
  misc_feature (1551)..(1551): n is a, c, g, or t
gagtacaccgcaaagttggtcgccagcgcgccatcgagcaaggtggccttgaagcccgcctcaaaagccttggagacttccttctcgtagctgtcgttgacgttgcggatgctgcggttcgtccccgtgcaacgcggcaagctcgccgggttctgcgcaacgccctggaaggtgagcgtcggcgccgtgccggtgcagaggcccgcataggtgctctcgatcgtggcgcgaacacccgtcgagttgaagccacctgagcggaagcccacgccgtaggacgtgaagaacgaaatgttctctgcggcatcccacttcagcgaaaacttcggctgcagttgcgagaacgtgcgcgaacggccaggaatggcggcgagcgcagcgttggtcgagtacgccgggttgatgaaggtggcggcacccgagaccacaccaaagaatccgggtgtctgcggagcaagcttcggaacgttgttgctgacatcgcgcttctcgcggtcgtaacgcagcgcgaccgacaattcgatgtcatcacgcacgtcgtacgcgagctgaccaaaagccgcgatcaccgagctgtcgaaatcgtcgtcatagagcaagtcggtcgggttaggtccgccggtacgcacgagcgcctgcgcgaggaagccttggccgttatccgaaccctgcgaaaccaccacacgacgcgcgatatcggcgaagtaggtgcctgcgacccagcgcaactgctggtcgcctggcgaggtcagacggagttcgaggctcgcgtcttgctgatcacgctgctgatactgataaccgtcgcacaagctcgggccgtacggcgggaagaaggtcgtcacgaagccgttggtcggcgcgtaaggaccgaagggcgccggcaacgggttgccggggcgcgcgtcgttgctcttttggcaggccggcgtgaggctgtagaggaagaacgccgcgctggtaccgtcggtgaggaagtagttggtctgatcgttgaaggccgcaacagcggtcagcgtgcccgaggccacttcccagtcacccttgaacgagagattgacgttctcttgctcgttctgcggcgtaacgttgttgacatatttaaatgcgtgcgtgttcggatcttctaggaagagcccgaggcccgggatgccgccgacttccttcagcgcgagcgacgcgttgaagttgatggcgcctgcatcgatcttcgagtacttcgccttgatgtcgaagttgcccgactcgcccatggggcccatgaggcgcgcgttaataccgctttcctcaaagaaatcgacgcaatcgtcgcagttgagcaggtcgttcttccactggccatcggtcttgcgcgtataagcggagaccgaacccttgtagtcgccaccgatggggccgccgacataggcgttcaacttgtagctaccgtagtcgccgtaacccgcgccgaggtcggcctcgaacatgtcgcccggcttgcgcgtggtgatgatcatggcaccggccacggcgttacggccgtagagtgcgccctgcggncccttgaggatntcgatctgcgagacgttcgcgagctcctgattgagtgcgttcgggttcgtttgcagcacgccatcgaccaccaacgcgaagttggtctcggcgtcgcggcccgtgttgatgccacgaatcgtgacctgcatgtcacccgcttcggccgtctgcacttgcgcgacacccggggtcaacgcgatgaagtcttgcggacgctcgatgcctgcggaagcgatctcggtcgcggtgaaagcttgcaccgtagccggcacgtcctgaatgcgctcggcgcgctgacgggcggtaaccacgatttcttcgagttgggcttcctgcgcacccgactgagcggcggcaacagcagcgatcacgctcgcgccaatcagcgagagcctgcgattacggtggaacattgatcctccggttcgatccgtgaatgggagtagtgggaaagccgccggagtctatgtcgcctcaggctaggcaatcaatgtaatttgcgtgctaccgcagatttatctgttgcaatttagcaacggtcgcggtttggaaaacggccggccgggtggacaaacgcacgtgccttgggcggcctcgggcatcatgagcatctgatttgagcagaggattcgaccgtgagcagcgccccacccgtacccgccatcgacatcgtcagcggcatttggaccgaggaagccctctcccaccgccccggctggcaagagcaattcttcgccgggaagatgaagtcgaagaccaacatgaaaggggtatcgctcgaagaccaactcgcgctgatggccgaggcgggtgtcgagcgggcgttcctgtttgcgcccaaagccggtcgccagggcctaccgggctcgttccatctgcccaacgacgtcgtcgctcgcgcgatcgagaagtacccgggccgtttttatggtcttgcaggactcgatccgtatgaaggcatgagcggcgtgcgcgcgctcgaagatgcggtcaaaaacatgggcttcatcggcgcgcatctttatccgcactggttcgatttgccgcccgatcacgccaagtactatccgttttacaccaagtgctgcgaactcggcgtgccgatccagatgcaggtgggtcagtcgatggtgtacgccaaagagcaacccatgcgcagcgtcggtcgcccgattctgctcgacggcatcgcctgcgattttcccgaactgaagttgatcggcattcatgtgggcattccgtggaccgacgaaatgatcgccatggcctggaagcacgagaacgtgttcatcggctccgacgctcacagcccaaagtattggccgccggcgttcgtgaactacatcaatagctacggtcaggacaaagtattgttcggcactgatttcccggtgctcggcttcaagcgcacgatggacgaagtgctcgggctgggcctgcgggcggatccgctgcgcaagtttctgcgcgacaacgcgctgcgcgtctacgggatcaaataattacggtgatttgcaaagccgtgagttgggtcagtcgctaccctgacccaccgactttacggcctgctcggccgtcatggcggcgccactcgccgtgagcgagtcgatggtggcgggatccaaccccgcctcacgcaagacttcgacggtgtgctcaccaagtcgcggtgccggtcgacggatcgaggccggcgtactgccaaagttcaccggaaaagaaggcagacgcaatttgccctcggtcggatgatcgaaggactgccagaaacccgtcgcttgaaggtgcggatcgttggcgagatcctcgagcgtgttcaccacaatgtgcgggatgccggagtgcgcgagcaccccgagccactcggccgtggtgcgtgtcgccatgatcattgcggtcgtttggttggtggcatcgatgttgcgcacccgatccgcaagcgtacgaaaacgctcatcgtcaatgaattgagggtatccggtgatctcgcagaacttcacccaatgggcatcgagataaggcagcaccgctatgtagccgtcttgcgtcttgtagggcttgcgatctttgctcatgagccgcgtgtagccgggcttgcccttgggcggatcgaaggtcatgccccacagatgctcggccatgacccaattgaccatggtctcgaacatgggcacctcgagctcctgcccctcgccggtgcgttcacgatgaaaaagcgcggcgagcacgccatacacgacggtgatggcggtggtcttgtcggcgacgatggtgggcaggtagcgcggctcacccagaaccatttcgttgagcatggcgatgccgctggccgcctggatggagtcatcgagagcgccgagcttgccgtagggccctttctttgagtaaccgtaggcgccgcaataaatgatgcgcggattgatcttgcgcagatcggcgtaatcgagaccaagcttggtcatcactt

SEQ ID NO: 1686 - DNA, 4000 bp, Escherichia coli
gttaataaatcagaatattcgtgatcatcgttaataccaacaaatacaccagtagaagaattttctaaagagtttggtggaataccagcattttctaaggcttcccaactagtttctaaaatccaacgatgtcttggatcaagagctaaggcttcatctggtaaacaattgaagaacttagcatcaaattgagatggcttagcaacactatttctagtatcgtataaacctaaacgaggaatattgtgttcagttggatctaattgatcacttggcttattaacgtaattacgatgtaaatctctagttttaattggaggtaaaacacaatccttacccttagctaaagctaaccaaagagattttgcactgttaatagcaccaggtaaacgaagacccataccaataatagcaatttttccattagactgtttttcatttaaggaagctggaatagattcacgaatttctgatacattcttttgatcaacattaccagataagaatttagcgagttcaaaagtattaccatagttgaaaagaatagctggtgagtaatgcttattcaattttcttgataatacattagttaatttaatagttgaaagagaatcaataccatagattgtgaatggactttctgggttgaaagattcgaattctggggtagatggaataatttccttgattgattgataaataagcttaatagcatcttgaatttcatcattaatttcttctctagtttttgtttctttattagattcttcctcttcatacgtaacattttcgttttcagtaacagtagatttattttgttctttttccatactaagaatcttgtcaatatccttaccactgtaactaacattaattgattcatcattttctttttcaactacttcttcatcaggaatttctgaaatttcaccactaataaccttagaaatatattttacgacgttagaatattgtaatcttgcaactcttcttgaaagagatcccttatcagtacttgggaattttttaccatagtctatgatgtatacattgtgaatagttaattgtttagcccaactagttaaactcttagagtcatccattaaaaccttaaaaatactattccaagtttgttcttgagcaattttacttaaagatttaatagtgcttctgtcaagagtggatggatcaatggaagtatcaaatggtttaccatcaacaataatttcttcccagtttggttcaacgaaacaaacaacttcagtttgagtggaatctaaaataagacaacaatgcttaatattagtacattcaaagttaatagtgttttcaaaaggtaatggattcatctttaaaccagtggcaaaggtaataatactatcaattctagtaacatatttataataaccagattttggtgaacgtttaagaacatcattagttttaaagtatggaacaccatcaatatcaacaaaaagatcttccttaccaacatcacaacgcatgcccgggactggtgaatcataaaattctcctggcttagctcttccaaagtaacctgtaacattagcagaagaatgggtataaagttcaccaatcgttggatcatcatcatttaatggtttaaagtagaaatcaacccatggaactctcatataatatccttcttcacctggtaatatttcaccctccataatatcatgtaaaacgtgaccaccttcagtggaacctaaaccattcataattaaaatatcaaatgtatctttataccatttagcaacaactggatttaatggagcaccaccagtcttaaaaactttatgttcatgatcttctctaaaataatcagcccaaatcttctttcttggatggttttcgtcaaataactttttatattcagcatactaattatacaataattaaataaataaaataaaataaataaataagtaaataaataaataaataaataaaaaaaaaaaacgtaaagataataatttttaataataaaaatatttaataatttaaaaaaaatgaatagttatattaaaaataaaaataacaaattttaataattaatttaatttaatatatataaattattttaaaataggtaattacttggaatgggaagtgacaaacactttgagctttagtttcagccatatcatctaaaatcatttcaggaacaaaaccaatatcacttaattgttgtgttttaaagattaaaccactagctccagtaacacagtaactaagtgcacaaattgcaccaaaggattgatggaatggaatacttttatttatttaatataaacaaaaaaaattttttttttttttgttttttattaataaaacttcattaccagtacatatatattaataattcctaaataataataacttactttacgaataaatcagtataaagtctattttgtggagtaaggaattgtttatatttatcaacacattgtttaaattgccatggaacgaatttcatttctaaaataggaaaatattttacaatgttaataaaacaaaataagcatttctattaatttatagttatataatctaaatctataataccttttttttttaagaaataaaaaagtattataaagataaagagataaatttctaaataattttaatgattataacaaaaaaaaaataaaaaataaaagaacaataacttactagtacattgaccattcttaataatagcttgtgatgaagaggaagtacccattacaagaagaacatcatcagggtcaccctttctttgatatgcttttccttcagcttttgcttgataaatttctttacataattcatcactataaatgaaacacattttgacaccttctttaccagcacataaaccttcatcttcttcagttaatggatgaatccatttccaaatccattgaccttgtttatttaatttttcatttttctcataatcatcataaagtctaaaattgacatcataaaatatcattttaatatcacaatgcttaacccagtattgtttaacatcattaccaagtcttggtggaaaagtaacaacaacacaacgtaaattccataatgcataaatcattaattgtgtaaatggtaatgtattagcaataataccaactcttgttcctggtgcaaaatcatatctttttttaagaacgtaagctgtagcttttacaagatcaaataattgataaaatggaatagttttccagttttctggataacgtgaactaatttcaggcttaaatgggaaaggtaataaattttccttagcaataatagctggttcattttttctcacaccattaaaacgaaggttcatcatatctatcatattatcaatgtcatatgaagcaatactaaaatatagaagagattattattcaatatttatatttaaaaaatattataatatattttaatgattattctttaaatgtactcttcaaataaattttacataataataaatagaataaaaacttttaaaaatagctaataaataaatatatatatatatatatattatattcatattaatattacgtttcttcatcttcatcacgtaataaatattttctttctaattcgacatttccaatgtaatcagttttatcaaagaaacccttcattttgaattttatatttgtaattaagaaaaaattttataattgaaaataatgtgaactatattttaattttgattttatatttactataaaaaattttttaaactcgatagttaatttctatattacttttatactttattattatatatacacaaattaatttaaataacagattgagaatttttatttaaattatatataaaaataaatattttaaaaattatataaaaaaatatttcattctattctaataaatacaaaataatataaagcaaaagtgataaaaaaagaaaaaaagaaaaaaaaaatactaaatacaactatttatattatttaat

SEQ ID NO: 1687 - DNA, 4000 bp, Escherichia coli
  misc_feature (2336)..(2337): n is a, c, g, or t
  misc_feature (2343)..(2343): n is a, c, g, or t
  misc_feature (2345)..(2347): n is a, c, g, or t
  misc_feature (2350)..(2350): n is a, c, g, or t
  misc_feature (2361)..(2361): n is a, c, g, or t
  misc_feature (2364)..(2364): n is a, c, g, or t
  misc_feature (2369)..(2371): n is a, c, g, or t
  misc_feature (2373)..(2375): n is a, c, g, or t
  misc_feature (2380)..(2381): n is a, c, g, or t
  misc_feature (2383)..(2383): n is a, c, g, or t
  misc_feature (2385)..(2386): n is a, c, g, or t
  misc_feature (2391)..(2391): n is a, c, g, or t
  misc_feature (2394)..(2395): n is a, c, g, or t
  misc_feature (2397)..(2398): n is a, c, g, or t
  misc_feature (2400)..(2404): n is a, c, g, or t
  misc_feature (2406)..(2418): n is a, c, g, or t
  misc_feature (2420)..(2427): n is a, c, g, or t
  misc_feature (2430)..(2435): n is a, c, g, or t
  misc_feature (2437)..(2438): n is a, c, g, or t
aaagtttgaatttttgtctctgctatcccaccacggttgtctcgatcaaacaaagcatgacaacttgcgcaattttttgaataaattgccgaacccaagctaacaagatttacatctaaatcaggcagcaacccattagccgaaaaatctgaccagcgtggagatttaagtgtttctaatttttcctccaaacccatcaagtgagttacgtttaccgaggagctgtatccaactggaagagtgctgttgttcgccacatcgacttggccgaatacacctaatacttggccaatattacgtcctaatgcgccagcccctgcgttcggaaccgagccattgtactgaaccacgtcaaaatacggtgcatcccacaaaaaaggataactcactggcgcattaggaggctgagcattgctaggcgtgtgcaacatttctgcggttacttggttcaaaatgacattcaaggcgtcaacgcgacccggacccggttttacatctgcttggtttcgctctaaccaatcttccatatgccgcatcgattgcctaagattttttcgaattccctctgggtcttttaccaaatatggactttctgcgatacgttttgcaaaacgattaaactttttgtcatcagcatatgtgtttatcaaagaccggttaagtgaatccataaacagccaaaaatcaaaatgcgatactccaccatcaattagagctgtcttatcaccaactttgatctcagtgacgtggcaagctgagcaattcataccaagatatgtttggttcggcatcctacctttgtcgacggtcaaacctattggtagattttctggatttgcttcggcatcatcccagtaaatcatgccaagaccttttaaaaatgaagattcaagaaacaatcgatctgtgtctggctgctccaatgatttagcaatgtcaaaaggaataatcggggagccttggggggaaaaataaaagaaggcgcggtcagcataatcccaaccttgatcgaccaataatgtattagattctgtgtaattttcagaaaaagccgagcctgagatcaaagcatacagaatgctcgaaacaccaattatttttttcattagacttctcctatgctgatgatgaaaccatcattatcacattatatacaaatatcccaatactgctttagcattaatcgttcaaatggttcgctttgcaaatcaaaatgtcaaccgatttagtgtcagtcttctggcatctcaagccactcatcgtcaggcttctcaagccactgaaggacaagtatggcaaaagtagtgattattcccagacggataaagtctttcagaatgaacccccactcgatagaataattaccgatagaaattgtatgattttgccagtcaccgatgttaaaaattatttcaattaaaggcatcaacgcatcgccaattactgtagaaataaattcacttgcggtgtgcccgaaggcgaatcccagtgccgcagctacaagaccaaatttgttcagcgtagttttcattctcgacattccataattactcccaaaccaaaccaatccattatcattttgcgcatgctagataaattatttcaagctgaggttaagcataaagcttgaaaaccaattcttacctactaaaaatatattaaaaacaatgacatattgcaatagccttatcctatttttcagtcgtcaaataaaatgggacggtgctgtcagacaaacgagcccaagcgtcagtattgggttgtcgctccttttctatgaaatcagcaacgaaggccactcaaatagcgcagcatcgcggttaagcttgaaagtattgcgtttcgagagggacctttgaaagttgagcagattgtaaaacgaggagtggattgagacgaacttctggagactgtgtattcgtctaaaccactgaattctgcaaaatatacccttaggtatatgtattatgagaggaaacaatctagagttgtttttcgaaaattggcgctattcatgaacggactacctatttgcatcagcataccccaccccgatcggtccctataccccctaagccaaatgagttcagtaaaaatttctaaaacaacaacatagcaatttggttgatttaagatttcggaagcggactctcggctaaatttaagaaaactaagcatgcgcataataaatgggtacgagagtgggtaccaccctaatcctcatataactcattgatttttttggtatgatggcggagcgacagggattcgaaccctggagacggtctcccgcctacacactttccaggcgtgcgccttcgaccactcggccaccnntccgtngnnnggngtttagacggnttntgggnnnannngcaannantnnttctnacnnanntnnnnntnnnnnnnnnnnnnannnnnnnntannnnnncnnttctgtttgccttttttctcgatcttgcccaaacggattgggccaatttcgccagtttttgccacatgcgttccgccacagggttgcaggtcaatttgatccgtatcattgccaattttaaccaagcgtattttgcccgacccacgcggtggttggacagacatggttttgaccagatcggggtttgcatccagctctgcgtcggaaatccagctctcggataccgataaattctgcgcaatcaggtcatttagggcgcgctcgatcgcgtctttgtctgtgggcgcttcgggcatgtcgaaatctagccgcgccttggcatgggtaatggatccgccggtcacaggacgcggaataacaacggataacaaatgtaacgccgtgtgatagcgcatatgcgcatagcgacgatcccaatcaatggtttgcatcacctcggccccgactggcaacagatccagatccgcgggatcaggataaatcacgatgtcttgctcgggtgctttgcgcacatctaaaaccgaaatggtttggccggcgacctcaagcgttcccagatcacaggcctgtccgcctgatgtggcataaaacagggattgatccagaataattccaccatctgccgtgtgggcaacaacgtggccttgggccattttttgataggcatcttgcaaaaataggggttcggtcattttttcaattcgtctatgtttttgatatagatgtcgcgctgcgcaaatgggatttcgatcccctcttggacaaagcgttctgcgatctggtgattgatttcggatttaaccacattcatataattgacgtcatgcaaaatggcgcgaatttcaaaatccagactatccgcaccaaagccctgaaacaccacagatggcggcgggttcagaacaatcattgactggttcgatgctatttcggccaagatctgttcaaccttgcgcgtatccgtgccataggccacgccgacgggaacaatcaaacggccgaccgtattgccacgggtccagttggtcaccaccccagataccaaatcggcattggggatgattacatccgtgcggtcaaaggtttcaattcgggtcgagcggacggaaatatcacgcacatagcccattttcccgccaacctcgatccaatcgccctgactgacggggcgttcaatcagcaaaatgatccccgacacaaagttagacacaatgttttgcaaaccaaaaccaatgccaacggacaatgcaccagcgacaatcgccagcgatgataaatccaaccccgtggacgaaatggcagccatggctgccaaaaacacacccacatagccaaaaccggaaacaatcgcattttgcgcgcctaaatcgagtttcgtttttggtaacaccgttccctttaacgcagattggatcaatcgcgtggcgccataaccgatggtaaagaccatgacaaaggtcatgaaatcaaggggcgaaatttgcgtgccgccgatggaaataccatctttgaactgggtccaaatttcggtcaaattcgccacacgcgcgccccagatcagc

SEQ ID NO: 1688 - DNA, 4000 bp, Escherichia coli
  misc_feature (1)..(1): n is a, c, g, or t
  misc_feature (3)..(3): n is a, c, g, or t
  misc_feature (5)..(5): n is a, c, g, or t
  misc_feature (8)..(12): n is a, c, g, or t
  misc_feature (16)..(18): n is a, c, g, or t
  misc_feature (20)..(21): n is a, c, g, or t
  misc_feature (23)..(27): n is a, c, g, or t
  misc_feature (31)..(31): n is a, c, g, or t
  misc_feature (38)..(38): n is a, c, g, or t
  misc_feature (41)..(43): n is a, c, g, or t
  misc_feature (46)..(46): n is a, c, g, or t
  misc_feature (51)..(51): n is a, c, g, or t
  misc_feature (54)..(61): n is a, c, g, or t
  misc_feature (66)..(67): n is a, c, g, or t
  misc_feature (69)..(70): n is a, c, g, or t
  misc_feature (72)..(72): n is a, c, g, or t
  misc_feature (74)..(75): n is a, c, g, or t
  misc_feature (78)..(81): n is a, c, g, or t
  misc_feature (83)..(83): n is a, c, g, or t
  misc_feature (85)..(86): n is a, c, g, or t
  misc_feature (88)..(88): n is a, c, g, or t
  misc_feature (90)..(90): n is a, c, g, or t
  misc_feature (94)..(94): n is a, c, g, or t
  misc_feature (96)..(97): n is a, c, g, or t
  misc_feature (102)..(103): n is a, c, g, or t
  misc_feature (105)..(105): n is a, c, g, or t
  misc_feature (114)..(114): n is a, c, g, or t
  misc_feature (117)..(118): n is a, c, g, or t
  misc_feature (121)..(121): n is a, c, g, or t
  misc_feature (123)..(124): n is a, c, g, or t
  misc_feature (128)..(128): n is a, c, g, or t
  misc_feature (131)..(131): n is a, c, g, or t
  misc_feature (133)..(134): n is a, c, g, or t
  misc_feature (138)..(139): n is a, c, g, or t
  misc_feature (141)..(141): n is a, c, g, or t
  misc_feature (173)..(173): n is a, c, g, or t
  misc_feature (235)..(236): n is a, c, g, or t
  misc_feature (242)..(242): n is a, c, g, or t
  misc_feature (266)..(266): n is a, c, g, or t
  misc_feature (269)..(269): n is a, c, g, or t
  misc_feature (1869)..(1869): n is a, c, g, or t
  misc_feature (2196)..(2196): n is a, c, g, or t
  misc_feature (2669)..(2669): n is a, c, g, or t
  misc_feature (2992)..(2992): n is a, c, g, or t
  misc_feature (3803)..(3803): n is a, c, g, or t
  misc_feature (3805)..(3806): n is a, c, g, or t
  misc_feature (3808)..(3808): n is a, c, g, or t
  misc_feature (3810)..(3811): n is a, c, g, or t
  misc_feature (3814)..(3814): n is a, c, g, or t
  misc_feature (3816)..(3817): n is a, c, g, or t
  misc_feature (3819)..(3820): n is a, c, g, or t
  misc_feature (3822)..(3822): n is a, c, g, or t
  misc_feature (3825)..(3829): n is a, c, g, or t
  misc_feature (3831)..(3832): n is a, c, g, or t
  misc_feature (3834)..(3839): n is a, c, g, or t
  misc_feature (3841)..(3852): n is a, c, g, or t
  misc_feature (3854)..(3857): n is a, c, g, or t
  misc_feature (3860)..(3861): n is a, c, g, or t
  misc_feature (3863)..(3866): n is a, c, g, or t
  misc_feature (3869)..(3869): n is a, c, g, or t
  misc_feature (3871)..(3877): n is a, c, g, or t
  misc_feature (3880)..(3887): n is a, c, g, or t
  misc_feature (3890)..(3893): n is a, c, g, or t
  misc_feature (3898)..(3901): n is a, c, g, or t
  misc_feature (3903)..(3903): n is a, c, g, or t
  misc_feature (3905)..(3908): n is a, c, g, or t
  misc_feature (3911)..(3914): n is a, c, g, or t
  misc_feature (3916)..(3917): n is a, c, g, or t
  misc_feature (3920)..(3921): n is a, c, g, or t
  misc_feature (3923)..(3930): n is a, c, g, or t
  misc_feature (3932)..(3938): n is a, c, g, or t
  misc_feature (3941)..(3941): n is a, c, g, or t
  misc_feature (3943)..(3955): n is a, c, g, or t
  misc_feature (3958)..(3962): n is a, c, g, or t
  misc_feature (3964)..(3964): n is a, c, g, or t
  misc_feature (3967)..(3968): n is a, c, g, or t
  misc_feature (3970)..(3970): n is a, c, g, or t
  misc_feature (3972)..(3974): n is a, c, g, or t
  misc_feature (3976)..(3977): n is a, c, g, or t
  misc_feature (3979)..(3986): n is a, c, g, or t
  misc_feature (3989)..(3990): n is a, c, g, or t
  misc_feature (3992)..(3994): n is a, c, g, or t
  misc_feature (3996)..(4000): n is a, c, g, or t
ncngnggnnnnnttannnannannnnnaagnagggggnggnnncanaaaanggnnnnnnnntttanntnnancnnccnnnnancnnanangggntnnaaatnngntttttaaanttnnaananntaantcnanngggnnanttatggcaaatactaacttaactaatcaaagncaggttttcgttgaggagtatgtacgctccggagatcacttggaagcagcaaagaaggctgnntacaangacactcatacattgcgtaatcangcntgtaagctccgcagagagtgattcagtataaatacctcaaatcaattttgtattacttaattttaggtatgcactattaatatccgtaccagatttaaaattagacaaatttggaaaaagagtttccatatcattatcaggaactccaaaccaactgcacaatgtagcattcatttgttccacagataatttaggcacaaaacgacctttccctccatttttgacgtcatcatctccccccatagtaaaattcggtaaatccccataaaactttccaccattgaaagtcgttccactgcttttactcatgaccaaattaatggtactccatgcgtgatccgtcccatctccattattcccaatggttcttccaaaatctgatgacgtaaaggtcgccactttgtcatccacacccatttcttctagtgctttttgaaatttccacagtgcaagacttaattctcgaagaagaacaggatgttcctcgggctgatttccatgagtatcgaaacttccaaaattgacgaaaaatatttgacgattgaaattcattttggaactggatgatcccaggtggatcaattgtgcaacagcttctaacttttctatcaggtcaccattcaattcctcctccatacctgttttagcttttgttggaattgaaaatagactttccccgtaagaagcagttgaactgaaagtttttttatgatttgaattccaataggtttgtaataaatcatctaaatcgagagatcccttgagcatctggttgtatacttttctaaatgggtcgcttcccggattatttctataaagtgttgaaaaaagatctcgacggctggaatagacagcattgtcggaatcttttttcatgtcccaataagtagtggtttgatccggactgaacagtataggcttactattaactccggtcatcagacggacttgaccattgaaagaaacattaagccccatcacactatcattgttgatcccagaccagagatcggccaatcttccagcccatcctgtcatgttaagatcgtctgctttgccagtataaatgatgcgtctttggtggttgtgtgcaaacaaaaaagatggttttttcttagcggcattctgaaaatcagtcttcccactgagtggctcaacaagagttccaatattaccaaccaaagaagctttcccatcttctagcaacctcgccaattcaggcatcattgcattaaccttcacttccgaaatcgatgtcaggggataagaacctcccaggtaggcagccgaatcactccctgaatcgtagtacggattgcctgaaccttgatttaaggttcctatacttggaagtgttttatcgctgtcggcgaccgagagatccccccttccattgttataaactgtccattgagaattcccagaacctgaagcaggaacaaatgaattccaggcatcatttcctccatttaagaagatacataccaatgctttatagcctgaaaaacttggagcagctgctttcaatcctaactgtggcatacccatcatcgatagacccgccagaccggactgcaaaaaatttcgtcttttcatatantttatttttgaatcataaaaaaacttgatgtaaccatgaagcgaattgcatcagaaatgacatttcttgcttcctttgcattaaactttttcccccaattcatattcattaaatgatttgtcaaggccgtataatattctgaaggcatttctcctcccataagttttttatcaaggtgctgtagtaatgattgaattgcagcctttttcttttctgaatcattaatgttattaaaatctccgtttgtatcaccgtccaaagcatattcaaaaatttgtagttcactatcgatattgatgtaataattttgttttgagtgatttcgancagaagcaaaatcctttaaggttgtattattttccaagattgcatttttttcattggtattgagtgaggacctgataaggttgtgaaatttgattaagacagtatcactttgaatttgaaattcaggtgccaccatactgttggaaatgaaatgagaatctgcaggaacgaaatcggacgcaaagaaattaaataccgtttcagatcttaatggcgattgtccgataatattttctagatagaaaaattgataaacaccattcattgttgcatttgttctgcttttccaaccatccagtggctttacatcaaaagctctaaggaattgggtcaaagctaataagggctctttaggttttccataattcccatcactgctgtattccgtctctcttgcttcaccgtccagcaaaacagcttttacaacttcttttaaatttccccgaatcccagccccatcattattgaaaatncctgcaactctgctgatataagccgatgaaggattagaagtaacaagtcttgtgattaaatgccgtcccacatgtgggcctacattttgatgctgaaagatgatttctagagcttgatcaaggtctgatggttcactgtttgatgatccttctgtaccaatcgtagaacctaaaaaggtttttgaagcatattcatgatgagttgaattaaattccatgggagaagaccattcttctccgtttgcccgactggtttttccatatttactgttacctttgatgtcataacctgtcattactttggcaagttcctcaacatcatnctgtgtgtaggaagcaataggatccccatttgaatccttaaccattgaaccatcctgattcattttccaaagccctattgaaaacaactgcatcaattctctggcaaaattttcatcaggatgggtattggaagaagaattgaattttttatttccttgatgagaaagaaatattcccattcctggacttcttgaaacttctcccatcaaagtcctgaaattcccaaatgcatactttgccaagatatcgtagtaggatgccaaagaatctcccctaaatcgagttctttgcttacttcctgatattaccatcaattcactcaatgccaatgctactcgttgtcggagctggtctttaccatggagtgcattctcaaaccaggctgcagtttggtaatcgcttgttctaccgtgaaaattattattaaagtctgaatctgattcgtatgtacttggttcagacatttttgcaatggctttatacttctgcagatgtgattggtgagaatctgttgaactatcgtaagcggaactagaatttagttgtttttcaatccattgggtcaaacctagagattgaacctcattcatatcatcttctgtgggtccaaacgtggcctgttctagaatgcggaacgcttgagctgtactaacatctgagcttgtagcttgaaccaaatcttgatcttttttctttttacaaccgatcaatatgaagaacgacaacagaagaactgagaataaaaagagacttgaaaggatgcctttcggaacttttttgtatttaatgataaatataccccatcttttncnncntnnaangnntnntnaannnnntnntnnnnnntnnnnnnnnnnnntnnnntgnntnnnnggnannnnnnncannnnnnnnaannnntcaannnntnannnnatnnnntnnttnncnnnnnnnnannnnnnntangnnnnnnnnnnnnntannnnntnaannanannnanncnnnnnnnngtnngnnngnnnnn

SEQ ID NO: 1689 - DNA, 4000 bp, Escherichia coli
  misc_feature (2031)..(2031): n is a, c, g, or t
tacctgcactcgaacgccacttttataaacaacaaaatcagggtctctagcagcaggacctgaagtctttgtcattgttaatgtgtggcttgcagctgtagctgtaaactttaaaaatgcacgatttccaagtttattataatcaccattatcatcaactgagcaaatttccacagcatctccatttacttcaacaaccttatgaataggaaggttggacgccagcccgccattatttgtttcgccagcgccgtaattttctgttgaattaataccacgctccgcagcaaatgtttcaattgctgcagcatcatcctgttgctgcgatttcaactctgctaaatatgaaaaaatcgagctaaacgctggatgatcagagtaactcgtcgcggtaaacgctgcataaataggtcccatcccgaaacgcataccgtcatcatcattagtaccgcgatcgtacaaatcataaagcacaccagcagtcgttcgctcgtcataccatcctgtattatcgttgctatctacatttattgaaaaaccctgcgactgaccgtttccataactgtcccggtaaaatgggtcgtccgtgaccatacctgaaagtgcattaccaaaaccctcccccatagcgacacgcatatcgagtttttgccccccgctgtgcggaccgcctatagaatctgaacgggacatttgatcttcaaaataatgcccccactcgtgaactactacgtgatcatcatattcatctgtatcagagtcctcatctcctagaatataaacgtttccatttcctttgtaggatgaagttcctatgtcacccgcggaatcattaccgctcactgcgcggttattaatactccagttatatttcatctctggaaaaacagcatctgggtcatctgcaatcattttttgaatggctacatatgttggagcaagcatagcaaatggagcagcggcccttgttgaagtataagaacttccgccccaaccagattgggcagttaacgcacgaatggaatctgatacgcccgaacttaataaatcgccagttaattcataaacagcattttgattggtattatcaatcacttttacattccaaccagcagtgcctgtactcgcttcctgtagcatttcagctcttgcaacaattcgtacatctgtatttggaaggacacttacactaaaatccccatttccatcagtaacagctgtgtctataataccccctgcagcattcctagcctgaactgtaatacccggagctcctcgctgaactgtagcgccatagtccaatccatttgtggaggtatttaaaggaacaagttcataactgatcttcccagtgattttcacatcatcgggtaaaggctcaacagtgacactcaatgtcgcattggcactatttcctgcagcatctgttgcagtagcggtacatacaaggtttgttgtggtggtaatagtaggggcagtgaacacaccatctgaaaaagaaccaccattggtacatgttgtcgttaacgatgtcactgcagcatcatcagtagcggttaagcttacctctgatgtttgaccagaatttacggttaagtttgcaacgctaaagctaacaacaggcgcggttgtatcaggattaactgtaactgttaaagttgcagacccttcgttgcctgcagcatcactagctgttgctgtacactcagaagtcaaagtttcacttgtttcaggagcagtaaatactccatcggaataatcaccaccattagtacaagaaacgttcggccctgttgtaatcccaacattatcagtagccgttaaagtagatgaaccagtgcccgttgaaactacagttagagaacttgggttaaattctaaagatggtgcttgagtatcaggtggtggcggggctggtggagttactgtgcttccagttccccccccgcctccaccacaggaaactattgctagcccgcctacagtgatgacagtactttgtaacagcgtcttaatgttcatatttttccnacacttttcttatattggtataaaccatttttggttttgtcaaatccattaaagaggtaaattgtcactataattggctatcaaaactaacactttttatcaacatatatatcgttttaccttcagtaagcttcagagactcaacccccgaccttgtaatccgggctgtaatttctaagtcagaaaatcttgcttttactaaagcgtagggcgattgagcatcaacactaataccaactatcatagcttctatacaattctgtatactgattttttttggtgggactaaggcaatagaaatagcatcagcatttattctaataaatattttctttccgctatagcgtctagatacatctggaaccttaattattgctccgccaatatcaacattaaccatggaaaactcgttatcttgagaaactatcattcctgaaaacaatgaagagagtttagtatcagtgtccaatgtagccacatctagttgaggtagtatttcatcaagtgatccaaaatccttaactctacccgatgacaataacatcacgtggtcagccaatctgcagacttcttctatgtcatgcgtgacataaatgcagggtatatcaaattttttaactaggttttcaataaaaggtataatggagcgttttcgtgctcggtccaaacctattagtggttcgtctaaaaataatatttcaggggctgatagaacggtcctggcaagagccacgcgccgagtttccccgccggataacacagatgggtattcagataataaagactctagttcaaaaacagaaattatttcatcaatcggtatcgcttttggtgcgcgtttttttgcaaattcgagattttgtaatacatttaaatgcggaaacaaacgcccatcttgaaacatgtacccaataggtcttttataggctgggaggtttaccttgtttttgctgtcataccataattcattcatttgaataatacctgagtctggacgcatgaagcctgatagtaattttaaaatacttgttttcccagaaccacttggcccgaatatgacagtgatacctttgcttggcaaagattggttaaccttgagggttattcttccaagtttctttaaaatatttattttcaatttatccgacatttaaaggatgcctgcgattaaaagtgtagatcaaaaataacacacaaaaagaaaatactaataatattccagaaagaatatgagcttgagtgtaatctaaagtctcaacgtgctcataaattgcaatcgacattacctttgtgcgtcctggtatatttcctcccaccattaaaataatgccaaactctccaagcgtatgcgcaaaggtcaaaattgaagcagttaagaagccgcgtttagataagggggcaacaattttgataaatacatccaatgggctagcacgcaaactcgctgcagcctctctaatctcgaagccaacattttcgaacgcgctctgtaaaggttgcaccatgaatgggagtgaataaataacagaagccagcactatcccaaaaaaggaaaagcttaagctttctccagtaaaattaatccagaaagatccaataggtgatgtaggattaaataaaataagcaaataaaatcctaaaacagtcggaggtaaaaccaaagggagggcagttaaggcttcaataaaaggcttaagtttcgaacgtgtgcatgaaagccaccatgccaatggggttccaataaaaagtaacaatactgttaccaccaaggataactttaatgttaatattaatggcccaaattcaatcattctgaggcacctcatatccagattttataatgatcttacgcgcctcatctgaacttaagaagctcaaaaaatcatgagcggctttatttgtgaggccgggtcttaataaaatagcatcttgcattattggtgtataaaagctttgcggtattctccaa

SEQ ID NO: 1690 - DNA, 4000 bp, Escherichia coli
  misc_feature (1985)..(1985): n is a, c, g, or t
  misc_feature (1992)..(1992): n is a, c, g, or t
  misc_feature (2412)..(2412): n is a, c, g, or t
  misc_feature (2662)..(2662): n is a, c, g, or t
  misc_feature (2887)..(2887): n is a, c, g, or t
  misc_feature (3074)..(3074): n is a, c, g, or t
  misc_feature (3328)..(3328): n is a, c, g, or t
  misc_feature (3547)..(3547): n is a, c, g, or t
  misc_feature (3714)..(3714): n is a, c, g, or t
  misc_feature (3736)..(3736): n is a, c, g, or t
  misc_feature (3886)..(3886): n is a, c, g, or t
  misc_feature (3914)..(3914): n is a, c, g, or t
gtgggctggttcggcttcaatgccggttcggccctggccgccgatgcgtccgcatcgctggcgatgctcaacaccatggtcgccaccgccgccggcgtggtcggctggaccctggtcgaggcgctggccaagggcaagccttcggcgctgggcgcggcctccggcgcgatcgcgggtctggtcggcgtcaccccggccgccggcacggtcgggccgatgggcgcgatcgcgatcggcctggccgccggcgtgctgtgcgtgtggggcgtgaacgggctgaagcggcggctgggcgcggacgacagcctggacgtgttcggcgtccacggcatcggcggcatcgtcggcgcattgctcaccggcgtgttcagcgcgcagtcgctgggcggcaccaaggccggcctggcgatcggcgcgcaggtatgggtgcagctggtcagcgtcgcattcaccatcgcctggtgcgcggttgtcaccgcggcggtgatgctggtggtcaaggccacggtcggcctgcgggtgagcgaggagtccgagcgcgtcggcctggacatcagttcgcacggggaatcggcctacgagtcctgaggacgcgtccgggaaccacgggcacggggcgggcggcggcggcgccgcccgttttttgcgccgccgattgcaattgcggcgtgcaggcggtgcaatgcgggaatgaagccgacccgactcctcgccgccgcctgcgtgctcgcgctcgcggcctgccagcacgccgcgccgcgcaacccgatggcgacctgggtgccttcgcggaattacgatgcgcgccgcgcgcagttgatcgtggtgcactacaccgagcaggactcggtgcagcacagcctcgacacgctgcgctcgagcaacagcggtggtcgggtgagcgcccactacctgctgggcgacgacggtcgcatctaccagctggtgtccgacgagcatcgcgcctggcacgccggcgccggccgctggggcacgatccacgaactcaattcggcctcgatcggcatcgagatcgacaacgacggccatgagcccttcaccgatgcgcagatcgatgcactgatccgcctgctggaagacctgacccgccgccaccggatcccgaagaccgaggtcatcggccattccgaccttgcccccgggcgcaagatcgaccccggcccgttgttcccgtggaagcggctgcacgaggccggcttcggcatctggcccgatcccgccgcgccgccgccgccgccgggcttcgatccggtcaacgcgctgcgcctgatcggctacccggtcgacgatctcgaagccacgatccattcctaccggatgcgtttccgcggcgacgatgccaggaccctcgacgaggaggacctgcgcatcctgaactcgctggcgacgcaggtgcacggagggcgctgaacccgcgccccggcccggatcgcattgggcggcgtcttgcactagattggtgcaatggatccagcgaaccctcttcccggccccgccctcgaccagctcggcacgccgctggcctgggccgaccgccaggcgcggatcgtgggggtcaacctggccttcccgcgctggatcggggttggtgcgcggcgtctgatcggccagccgctggccgcgctggaactggaaggcgacgccctggcccggttcctggcccaggacgagcgcgaagtgctgcgcctgcaccgcattccgctgggggtcccgggcgaggcgccgcgtcctgccgacggctggctgacccgtacccccgatggctggctgctggaggcgcatccggccgacgactccccctcggccgatccggcccaggccctgcccggcgcgctgcaggccgcactcaagggcatggcccacgaactgcgcaatccgctggccgggctcaagggcgccgcacaactgctggcccgccgcgccggtgcgcgtcccgaggccggcgacgagcgcgagttgatcgncctgatnggcgccgagatcgaccgcctcagccagctggtcgaccaactgctgtcgcccgccccgcagcgcccgcacgcgccgctgaacatccatgccgtgctcgaacgggtgctgcgcctggccgaggccgagggcggctggacgatgcgggtgcagcgcgattacgaccccagcatccccgagttccccggcgatgccgaccgcctcacccaggcggtgtggaacctggtccgcaacgcgctgcaggccggcgcctcgacgatcgtcctgcgcacccgggtcgagagcggcctgcacatccgcgagcggctgcatgcgcgcgcgctgcgggtggagatcgtcgacgacggcggcggcgtgccggaggaattggccgagcacctgttcctgccgctggtcagcggccgtgccgaaggcaccgggctnggcctggccctggctcaccaggtcgcgcgcgagcatcgcggctcgctgggtttccgctcgcgccccggccataccgtgttcaccctgctgctgccgcagaacgagcccgaaggagcgtctttgccatgagtttccctgcatgagcgccgccagcggcaaccgccgggtatgggtggtcgatgacgaccgttcggtgcgtttcgtgctggccaccgcgctgcgcgacgccggctacgaggtggacggtttngagaacgcggccagtgcgctggacgcgctgcaggtacgcggcgtgccggacctgctgttcaccgacgtgcgcatgcccggcgaggacgggctgaggttgctggaacggttgaaggcggcgcacccgcacctgccggtggtcgtgatgtcggcctacaccgacgtggccagcaccgccggcgcgttccgcggcggcgcccacgaattcctgtccaagccgttcganctcgacgatgcggtggcgctggccgcgcgcgcgttgccggcacctgcgtcctcggcgcccggggcgtcgccgccgcaggcggagccggatgccgcgggatccaccgcgaccgcgcacgagctgatcggcgacaccccggccatgcgcgcgctgttccgcgcgatcggccgcctggcgcaggtgccgntgtcggtgctggtcaccggcgagaccggcaccggcaaggaactggtggccggcgccttgcaccgcgagtcgccgcgcgcgtccgggccgttcgtcgcgctcaacaccgccgcgatcccggccgagttgctggagagcgaactgttcggccacgaggccggcgccttcaccggcgcgaaccggcgccatgtcggccgcttcgagcaggcccacggcggcaccctgttcctggacgagatcggcgacatgccggcntcgctgcagacccggctgttgcgggtgctggccgagggcgagttcttccgcgtcggcgggcgcgagctgatccgggtggacgtgcgggtgatcgccgccacccaccaggacctggaggcgcgggtcgccgaaggccgcttccgcgccgacctgctgcaccggctcgatgtggtacggctgcggatcccgccgctgcgcgagcgtcgagccgacatcccnctactggccgccaccttcctgcatcgcgccgcgcacaagctcggcgccggcgccaagaacttcgatccggcggcgctggccgcgttgcaggcgatggactggccgggcaacgtgcgcgaactgcagaacctgtgctggtcgctggccgcgctggcaccgggcgaaancattaccgcgggggatctgggnatgctccaggccccggcggccgccagcgcggcgacaccgccggtggagtgggatcgccagctcggccagtgggcgctgcaaagcctgcaggccggtgcgcgcgacctgcatgcgcaggcgcggatgcgcttcgaacaggccctgctcaangccgccctgcagcacaccggcggccgcngggtggaagccgccgcgctgctcggcgtgggccgcaacaccgtcacccgcaagctcggtcccgggcgcaagcgtcgctgacggctt

SEQ ID NO: 1691 - DNA, 4000 bp, Escherichia coli
  misc_feature (97)..(97): n is a, c, g, or t
  misc_feature (127)..(127): n is a, c, g, or t
  misc_feature (147)..(148): n is a, c, g, or t
  misc_feature (331)..(332): n is a, c, g, or t
  misc_feature (334)..(334): n is a, c, g, or t
  misc_feature (559)..(559): n is a, c, g, or t
  misc_feature (607)..(607): n is a, c, g, or t
  misc_feature (707)..(707): n is a, c, g, or t
  misc_feature (713)..(713): n is a, c, g, or t
  misc_feature (728)..(728): n is a, c, g, or t
  misc_feature (794)..(794): n is a, c, g, or t
  misc_feature (827)..(827): n is a, c, g, or t
  misc_feature (890)..(890): n is a, c, g, or t
  misc_feature (971)..(971): n is a, c, g, or t
  misc_feature (1028)..(1028): n is a, c, g, or t
  misc_feature (1151)..(1151): n is a, c, g, or t
  misc_feature (1184)..(1184): n is a, c, g, or t
  misc_feature (1304)..(1304): n is a, c, g, or t
  misc_feature (1364)..(1364): n is a, c, g, or t
  misc_feature (1391)..(1391): n is a, c, g, or t
  misc_feature (1463)..(1463): n is a, c, g, or t
  misc_feature (1469)..(1469): n is a, c, g, or t
  misc_feature (1499)..(1499): n is a, c, g, or t
  misc_feature (1502)..(1502): n is a, c, g, or t
  misc_feature (1589)..(1589): n is a, c, g, or t
  misc_feature (1637)..(1637): n is a, c, g, or t
  misc_feature (1796)..(1796): n is a, c, g, or t
  misc_feature (1988)..(1988): n is a, c, g, or t
  misc_feature (2006)..(2006): n is a, c, g, or t
  misc_feature (2509)..(2509): n is a, c, g, or t
  misc_feature (2563)..(2563): n is a, c, g, or t
  misc_feature (2584)..(2584): n is a, c, g, or t
  misc_feature (2683)..(2683): n is a, c, g, or t
  misc_feature (3301)..(3301): n is a, c, g, or t
  misc_feature (3307)..(3307): n is a, c, g, or t
  misc_feature (3412)..(3412): n is a, c, g, or t
  misc_feature (3484)..(3484): n is a, c, g, or t
atcaaacaaaaaggtcctttgcttagaggatgaagaggcgattttgcgaaatatctgcgcctcgctggagctctttttcgcagaggttaaaggcgtnacagacggctttgatgcgcttgagcttgcnatgagcggggcgtatgacgnnctagtgcttgatatcagcgtgccaaatatcgatggtcttgagatcgctaaaaaagtaagagctatcaatcaaaaaatccctatcgtgatcttatcaagccacgtcgagcaagagtatctgtggcgcgcggttgagctaaagatcacaagatatcttgcaaaaccatacgataaaaaatctttnntnaaagcgcttgaagatgtggcttttgagctagttggacgcacaccaactatcaggctaaatgacgagcttgagtatgattttggcaaaaaagcgctttatgtaaatggcgaaatttctcatctaagcaagagcgagagcaagcttttggagtactttttaaacaacaaaaaccaaactatcacttatgagcaaatttttgactacatctgggactacgagcagccnacaaaagaggcgataaagacgatcgtaaaagagcttagaagaaagctnggcaaagatgtgatcaaaaatttatacggcgtgggctatctttgtgagatataaatttcagctaatagtcggtgcttttatctttgtctatctgctagtntcggcncttgttttaaatttntacaacgatcttgcgatgaaagacgccaaaaaagaggcgtattatgttttagagggcataaattcngtaagagagtacatcgctggagttcagcgcccnctaatcgagcagttaaaagagcagggcatcttaaaagaggacttttttgacgagagacttctntcatcttcatatataagccgtgaaatttacaacatccaaaagaaaaaatacaaccttgaatttgactacaagctagttgcnatcgctccgctaaataaagctcacgagccaaatgaatttgaagctggcgtcttgcanggctttaaagagaataaatttaaagaatttgtaaagataataaaagatgaaaatggctcacagctctttgtgggtctgcctataaaaaaccaaagtccaagctgtctagcctgtcatagcagngcaaatgccccacaacaaatgctagaaaaatanggcatggagggcatagagatcccagacgtgaacgaaacggtcgcgatgatctcttttaagataccaatccgcgccatttttacctaccacttgcaagaggtcatcgtcataatgagcgcnataacgcttatctttgggctatttttgctacttgtttataagatgcataggcgaggcgangagagcaaaaagcagactgagcagctnatgatacatcaaagccgcctagcctctatgggcgagatgataggcaatatctcgcaccagtggaagcagccncttgcncagataagctcagctttgataaatttaganctntatcaggagcgaaaaaagcttgatgaggcgaaaatttatgagtttatagaagagacaagcaagcagataaatttcatgtcagaaacngttgatgactttaaaaatttctttagtccaaataccttgagaaaagantttaaggtgcttgaagtgataaatcaaacgataaaaattttaaacgcaacgcttaaaaagtatcagatcgaagtgcagcttgacgtgagagaaaattttgaggtatttgcaaattttaatgagataatccaaattttaataaacatcataaacaacgcnaaagacgcatttaagcagagctacacaaagccaagagtgataaagataagcgcctttttaaaagatgatcgcaagaatttatgcgtgcaaaataacgcaggagcgataaaaaattcatttttaaaggtcatctttgagccacactttagcacaaaagagagcggtagcgggcttgggctatatatgagccgncttatcgctcgcaaaaanaacgccctaatctttgctaaaaatgtggatgaaaaccacgttgcatttacaattagtttcgaaaatttataatttgttaattttcccccttttctgcccttttttggtgttaagattatcagtatgaaatcattttgattttaggataaaaattcaaaggaggagacgtgagaaacttacacaaagccttagcaggcttactcatgggtgttagtatctttgcttcacaagcctgttgcgaagagcataatatgcagatgtccgataaagcacgtgatgttatcgcaaatcctaaaggcacactgcaaagtagaggtgttgtctccttgcaagactacgtcgtagaagagcaagagatgtataactggctatttaaaaaccaccctatttttacaaagtatggtggcaaaaccgtcggcaaaatggtcgttcatgaccgtggcttagagtggcttgccgagggacatggctttgatatgtcaaagcttagtaaaagagatggnggtaagggctatagctctatgatgtatagaattccagccacctcatcacttcantttcctaataaatttgtaggnccagaaaagtgcggtgagtgtcacccagctcagtatgaggtctggagcagatctcgccacgcaactactatgcgcttccctggcgagcacccagaggtnaataacaacctaactgagccagtatttgacaaagataccgcttctatccttccaaaaggtatcactccagatgtcatctacgcaaccgttggtcacttaagaactaagatgggctacgtcgatgcatggctacttcgtggtacttactacgttgagggcggtttgctaagagatggcacaggtcagatcgtagctggcggtaaccaatggcaaagaacatgggcgttaaatttagacgacgcaactgttaaaaagataaaagagctcgtcccagaatttcctggcacgcttgaagagtatggcgataatggcggatatgttagaggtcttgcctcatacgccgcaaaacataaaaagtcgatgtttttccaagcaaactcatcatattgtgaggtttgccacccagttaaatttgactttaagtcaaaagcagaattttacgcagcacttggtaatgccaaagagcttcaaaaacacactatctcaaaaggcgtaagctgtgaggagtgccacggagctggcggtcaccttgatggagctacaaattttagaacatcaaactgcgaacgctgtcaccaaagatttaactttagcccagatctaatgcgagctaacccncttaanaacggcaagcttgatctctcactaagctctaaatttaaatcaatgggaccaggatgcggctcagaaggctcacaatcatactttaccgctcactacgataaaggnatgagatgcgtcacttgccacgatccacacgacaacacaggtaacgttgtaggcgataagagcgtaactggnatgaactacaacccagatcaaggctatctaagtgcgttctacactaaaccaaagatcaaaaaagattgtaaagattgtcacgagactcaagcatatatcgcatcaaaagcagatactcacaaaaacaacacttgtgcatcttgccacatgccatttatgatgagctgcgagaatttctacgctgttcagttccaagacaacgctggctttgatactcaaagacgctctcacatctggaagatcatggtcgatccaaaagagaaatctcttgtcccaggcgacgctgctaaaggtccaagagatgctaaagattggcactttgagagagataaaaatggccacaactatgttgatttgatgtgggcatgcgctagaacatcttgggctgataaagatatgaaagataataaaggctgccatagcccagtgctatctgagctaaaaccaacacttcacttcaaaaaccaaaaacaagtttatgatgaggttatgggatggcaaactccagttaaaaat

SEQ ID NO: 1692 - DNA, 4000 bp, Escherichia coli
  misc_feature (509)..(509): n is a, c, g, or t
  misc_feature (576)..(576): n is a, c, g, or t
  misc_feature (948)..(948): n is a, c, g, or t
  misc_feature (1528)..(1528): n is a, c, g, or t
  misc_feature (1540)..(1540): n is a, c, g, or t
  misc_feature (1544)..(1544): n is a, c, g, or t
  misc_feature (1574)..(1574): n is a, c, g, or t
  misc_feature (1795)..(1795): n is a, c, g, or t
  misc_feature (1815)..(1815): n is a, c, g, or t
  misc_feature (1966)..(1967): n is a, c, g, or t
  misc_feature (1974)..(1974): n is a, c, g, or t
  misc_feature (1976)..(1977): n is a, c, g, or t
  misc_feature (1987)..(1987): n is a, c, g, or t
  misc_feature (2861)..(2861): n is a, c, g, or t
agaaaatctgagacagtaactattgcagggaatcaattagcaacacctattactgcgggtgtaaatgaaactttccaaccatttgatgaagaaagatattcattgattaggtccgatggatctacagaactattaactgcagataaatttggatttagtgctgcttcaacatcacttcaaatttataatttaggagcagctgatggtgcagcaagactaacatatacgttgaagaaaactaaacccaaagcaaagaaaaagagaaaaaatagagttaatacagttataattgataaatccactcttgaaggatctggttctggtgatggaactcttgatgatggattaacatatggtagttatccatatggaacaagagttcaagatgataaaatttcactaaatcttgctgatcttgttgaagttcatggcatttatgaatcaacagatattacagaaccttctgcgcctacggttatattgtcttctatttctggacctgcaggtantacatcagatctcatacttggtgaaaaaattataggtcagaatagtaaagcaattggtattgttgcngcaaaacttacagattctcaagttgcatttattcccaaaaattcatataatttaagagaaggtgaagttgtaaaatttgaagaatctaaaattcaagcaacagtttcccaattaaatgaatctagttttaatatttcaaaacattatagttatactgctggacagcgtggatctttctatgactatggatctataaacagaaaagatgattttgaagcacctacaaagcagttgaaaatttatttttcaaatggatattatgattccagcgatgatggagatattacaacagttgattcatacaccgaatcatttgattatactactgacattagatttataaatggagagagattaactgatattattganattagaccgaaagtttctacttatacagttgctgcagacgcaaggtctccgtttgagttttatggtagaacatttaatgaagcaggaaattctgctgcaaatattttagcatcagacgaatctcttaatttcacatattcattctatcttgcaagaatagatagaatttatctcactaaggatggaaaattccaaattcaatatggagattcggcagaaattccagatttgcccgtaccaattgataatgcaattgaaattgcaagaataaatcttcctccatatctttatcaaccttctcaagcttcaattgattttatggagcataagagatatagaatggtcgatattagacaacttgagaagagaattaaaaatcttgaatattatacatcattaagtttacttgaaacaaacactgctaatatgtttgttgctgatagtcaaggtttgaatagatttaaatctggattctttgttgataactttactaatgcaagaactcaagagaatgaacttccttataaaaatagtattgatattggaaataaaacattaaaacctcaacattatacaaatncaattgatcttnttcnaggtcctgttgttaatgttgatcctacagnggatttagcattcaggtctcccgaaggtattaatataagaaaaacttctgatgtaattactcttgattatgctgaagttgaatggttatctcaaaattttgctactagaactgaaagtgtaacaccatttttggtaagtttttggcaaggttcgcttacattaacacctgccacagatacttggattgatactacaagattagaagcaaagattattaaanctgaaggtgattataatganaccatgagacagatggttgaaaataataatgttgatccacaaactggatttgctcctactatttggaatgcatgggaaaccaattggacgggaagtgatgttacgacatccacaagaaccagaacgattaggagtggtagagtaccatctnntcgtggncnnggtggtacgnctcgccaacggacaattaattatacactgacaaatacagttattcaagaaacgttaagagaacaaagagatactggtgtaagatcaagaactggaagtagacttagtgttactgaacaatgggataatacttctgttggagatagagttgtaagtagagatgctgttccttatatgaggtccagaaatattcaatttgttaataagaaagttaaaccacttacaaaaatgtttgctttctttgatggaatgaatgtaactagattctgtgttccaaaacttcttgaaatttctatgacttctggcacatttgatgttggagaaactgtaattggaactgcacagcgaatgggtgttggacctaattgggaagcatcaagtccaaaaataacattcagaactgcacgatcaaatcataagtctggtgaatataattttcctacaaccacatataagcaaaacccatataattcacggccacttgctgaatcttattcatcatcatcaacaactttgaatattgatacattctcattacaagaacaggcacaaggtgagtattttggttgggttgaaccaggaatgattcttgttgggcaaacaagtggtgctcaagcaacaattacagaccatagattgatttctgatatagctgcagacttaaatggtagtttctttattcctaatccgaatattgagacaaatccaaaatttgaagcgggaacaaaagtacttacttttgttaatgatagcgcaaacaatcaagaaactgcgactacaatttctgaagaaggatacaatgcaacaggaactcttgaaacagtacaggaaaatattatttctgtgaggaatgcaagagttcaaaataaacttanatttgaagatcacgcagttaatagaacaactggaatgcaagttattcagactagaactctgagtagtcatacatcacgtcatagtatgactcaatattatgatcctttggcgcaatcattcttagttgatgaagaaggtggtatctttattacaagatgtgacatattctttaggagtaaggatgatgataatattccagtaactcttcagattagaacaatgaaggagggaacaccaacacaaaaggttttaccattctccgaaattattttaaatccagatgatattactacttctggagatggatctgttgcgacaccatttgtatttgatgctcctgtttatcttgacggaaatgatgaatatgctatttgtgtagcatcaaattctactaagtatagcgtttatatttctagaattggtgaaaatgatctcttaactgatgcatttatctcaaaccaaccatatcttggttcactctttaaatcacagaatgcttctacttgggaacccagtcaatgggaagacttgaagtttgttctttatagagcagattttgttgataaaggtacagttgagttttataatcctgcattaagtgaaggaaatggacaaattccaacattgatggatgattcattgtctatgaattcaagaaaagtaagagttgcactttccacaacaattaatgatccagatctttctgttggtaatattattagtcagacaggaaataatgcaactggtaattatgttggagctgctggtagtgcgacaggaactttaaatgttattaatgttggaattggatacactggtccatttacttatcctggagttaatttaacaacacttactggagatggtagtaatgcaactgctgatattcaagttaaaattgatggaacagttggatttgcaactattttagcaggtggatctggatatttgatcggtgatactcttggcgtaactactattggaagtaataatgttggtactgcattacgactatctgtcacatcaattggaagtactaatgaatttattattaataatgttcaaggaaactttatttctgttggatcggcatctactgttcaatttattaatggatcaggaataacaacagcattaa

SEQ ID NO: 1693 - DNA, 4000 bp, Escherichia coli
  misc_feature (2)..(3): n is a, c, g, or t
  misc_feature (5)..(5): n is a, c, g, or t
  misc_feature (8)..(8): n is a, c, g, or t
  misc_feature (10)..(10): n is a, c, g, or t
  misc_feature (15)..(15): n is a, c, g, or t
  misc_feature (18)..(21): n is a, c, g, or t
  misc_feature (30)..(30): n is a, c, g, or t
  misc_feature (32)..(34): n is a, c, g, or t
  misc_feature (36)..(36): n is a, c, g, or t
  misc_feature (38)..(38): n is a, c, g, or t
  misc_feature (41)..(41): n is a, c, g, or t
  misc_feature (45)..(45): n is a, c, g, or t
  misc_feature (47)..(48): n is a, c, g, or t
  misc_feature (54)..(54): n is a, c, g, or t
  misc_feature (57)..(57): n is a, c, g, or t
  misc_feature (59)..(59): n is a, c, g, or t
  misc_feature (61)..(61): n is a, c, g, or t
  misc_feature (65)..(66): n is a, c, g, or t
  misc_feature (68)..(68): n is a, c, g, or t
  misc_feature (70)..(71): n is a, c, g, or t
  misc_feature (73)..(76): n is a, c, g, or t
  misc_feature (78)..(78): n is a, c, g, or t
  misc_feature (80)..(82): n is a, c, g, or t
  misc_feature (84)..(86): n is a, c, g, or t
  misc_feature (88)..(90): n is a, c, g, or t
  misc_feature (93)..(100): n is a, c, g, or t
  misc_feature (103)..(103): n is a, c, g, or t
  misc_feature (105)..(105): n is a, c, g, or t
  misc_feature (107)..(111): n is a, c, g, or t
  misc_feature (114)..(114): n is a, c, g, or t
  misc_feature (116)..(116): n is a, c, g, or t
  misc_feature (120)..(122): n is a, c, g, or t
  misc_feature (124)..(124): n is a, c, g, or t
  misc_feature (128)..(129): n is a, c, g, or t
  misc_feature (131)..(132): n is a, c, g, or t
  misc_feature (137)..(137): n is a, c, g, or t
  misc_feature (139)..(147): n is a, c, g, or t
  misc_feature (150)..(151): n is a, c, g, or t
  misc_feature (153)..(153): n is a, c, g, or t
  misc_feature (157)..(158): n is a, c, g, or t
  misc_feature (160)..(162): n is a, c, g, or t
  misc_feature (166)..(166): n is a, c, g, or t
  misc_feature (168)..(168): n is a, c, g, or t
  misc_feature (173)..(174): n is a, c, g, or t
  misc_feature (178)..(178): n is a, c, g, or t
  misc_feature (180)..(180): n is a, c, g, or t
  misc_feature (184)..(184): n is a, c, g, or t
  misc_feature (186)..(186): n is a, c, g, or t
  misc_feature (188)..(188): n is a, c, g, or t
  misc_feature (190)..(192): n is a, c, g, or t
  misc_feature (195)..(195): n is a, c, g, or t
  misc_feature (197)..(198): n is a, c, g, or t
  misc_feature (200)..(205): n is a, c, g, or t
  misc_feature (207)..(216): n is a, c, g, or t
  misc_feature (218)..(218): n is a, c, g, or t
  misc_feature (220)..(221): n is a, c, g, or t
  misc_feature (223)..(225): n is a, c, g, or t
  misc_feature (227)..(228): n is a, c, g, or t
  misc_feature (236)..(237): n is a, c, g, or t
  misc_feature (241)..(242): n is a, c, g, or t
  misc_feature (245)..(245): n is a, c, g, or t
  misc_feature (251)..(254): n is a, c, g, or t
  misc_feature (258)..(258): n is a, c, g, or t
  misc_feature (260)..(261): n is a, c, g, or t
  misc_feature (263)..(265): n is a, c, g, or t
  misc_feature (268)..(268): n is a, c, g, or t
  misc_feature (271)..(274): n is a, c, g, or t
  misc_feature (279)..(281): n is a, c, g, or t
  misc_feature (284)..(284): n is a, c, g, or t
  misc_feature (286)..(289): n is a, c, g, or t
  misc_feature (291)..(292): n is a, c, g, or t
  misc_feature (294)..(297): n is a, c, g, or t
  misc_feature (299)..(299): n is a, c, g, or t
  misc_feature (301)..(301): n is a, c, g, or t
  misc_feature (303)..(304): n is a, c, g, or t
  misc_feature (306)..(307): n is a, c, g, or t
  misc_feature (309)..(309): n is a, c, g, or t
  misc_feature (313)..(314): n is a, c, g, or t
  misc_feature (316)..(316): n is a, c, g, or t
  misc_feature (318)..(318): n is a, c, g, or t
  misc_feature (320)..(320): n is a, c, g, or t
  misc_feature (324)..(324): n is a, c, g, or t
  misc_feature (326)..(328): n is a, c, g, or t
  misc_feature (330)..(334): n is a, c, g, or t
  misc_feature (338)..(338): n is a, c, g, or t
  misc_feature (341)..(341): n is a, c, g, or t
  misc_feature (343)..(344): n is a, c, g, or t
  misc_feature (351)..(358): n is a, c, g, or t
  misc_feature (360)..(360): n is a, c, g, or t
  misc_feature (362)..(362): n is a, c, g, or t
  misc_feature (364)..(364): n is a, c, g, or t
  misc_feature (368)..(368): n is a, c, g, or t
  misc_feature (371)..(371): n is a, c, g, or t
  misc_feature (373)..(373): n is a, c, g, or t
  misc_feature (375)..(375): n is a, c, g, or t
  misc_feature (377)..(378): n is a, c, g, or t
  misc_feature (380)..(382): n is a, c, g, or t
  misc_feature (384)..(384): n is a, c, g, or t
  misc_feature (388)..(388): n is a, c, g, or t
  misc_feature (390)..(391): n is a, c, g, or t
  misc_feature (394)..(397): n is a, c, g, or t
  misc_feature (399)..(399): n is a, c, g, or t
  misc_feature (401)..(405): n is a, c, g, or t
  misc_feature (409)..(412): n is a, c, g, or t
  misc_feature (415)..(415): n is a, c, g, or t
  misc_feature (417)..(417): n is a, c, g, or t
  misc_feature (419)..(419): n is a, c, g, or t
  misc_feature (421)..(425): n is a, c, g, or t
  misc_feature (427)..(432): n is a, c, g, or t
  misc_feature (434)..(436): n is a, c, g, or t
  misc_feature (438)..(440): n is a, c, g, or t
  misc_feature (442)..(443): n is a, c, g, or t
  misc_feature (445)..(447): n is a, c, g, or t
  misc_feature (450)..(459): n is a, c, g, or t
  misc_feature (462)..(463): n is a, c, g, or t
  misc_feature (465)..(465): n is a, c, g, or t
  misc_feature (469)..(469): n is a, c, g, or t
  misc_feature (471)..(472): n is a, c, g, or t
  misc_feature (474)..(487): n is a, c, g, or t
  misc_feature (489)..(494): n is a, c, g, or t
  misc_feature (496)..(496): n is a, c, g, or t
  misc_feature (498)..(503): n is a, c, g, or t
  misc_feature (505)..(505): n is a, c, g, or t
  misc_feature (508)..(509): n is a, c, g, or t
  misc_feature (513)..(513): n is a, c, g, or t
  misc_feature (517)..(519): n is a, c, g, or t
  misc_feature (522)..(523): n is a, c, g, or t
  misc_feature (525)..(525): n is a, c, g, or t
  misc_feature (527)..(527): n is a, c, g, or t
  misc_feature (530)..(530): n is a, c, g, or t
  misc_feature (533)..(535): n is a, c, g, or t
  misc_feature (537)..(542): n is a, c, g, or t
  misc_feature (544)..(551): n is a, c, g, or t
  misc_feature (553)..(554): n is a, c, g, or t
  misc_feature (556)..(557): n is a, c, g, or t
  misc_feature (559)..(559): n is a, c, g, or t
  misc_feature (561)..(563): n is a, c, g, or t
  misc_feature (565)..(565): n is a, c, g, or t
  misc_feature (568)..(574): n is a, c, g, or t
  misc_feature (577)..(580): n is a, c, g, or t
  misc_feature (582)..(598): n is a, c, g, or t
  misc_feature (600)..(601): n is a, c, g, or t
  misc_feature (603)..(604): n is a, c, g, or t
  misc_feature (607)..(608): n is a, c, g, or t
  misc_feature (610)..(615): n is a, c, g, or t
  misc_feature (618)..(620): n is a, c, g, or t
  misc_feature (623)..(623): n is a, c, g, or t
  misc_feature (627)..(636): n is a, c, g, or t
  misc_feature (638)..(642): n is a, c, g, or t
  misc_feature (644)..(655): n is a, c, g, or t
  misc_feature (657)..(658): n is a, c, g, or t
  misc_feature (661)..(665): n is a, c, g, or t
  misc_feature (667)..(671): n is a, c, g, or t
  misc_feature (673)..(674): n is a, c, g, or t
  misc_feature (676)..(681): n is a, c, g, or t
  misc_feature (683)..(683): n is a, c, g, or t
  misc_feature (686)..(686): n is a, c, g, or t
  misc_feature (688)..(688): n is a, c, g, or t
  misc_feature (690)..(692): n is a, c, g, or t
  misc_feature (694)..(695): n is a, c, g, or t
  misc_feature (697)..(699): n is a, c, g, or t
  misc_feature (702)..(702): n is a, c, g, or t
  misc_feature (704)..(707): n is a, c, g, or t
  misc_feature (709)..(709): n is a, c, g, or t
  misc_feature (714)..(715): n is a, c, g, or t
  misc_feature (718)..(718): n is a, c, g, or t
  misc_feature (720)..(722): n is a, c, g, or t
  misc_feature (724)..(729): n is a, c, g, or t
  misc_feature (731)..(732): n is a, c, g, or t
  misc_feature (734)..(739): n is a, c, g, or t
  misc_feature (741)..(741): n is a, c, g, or t
  misc_feature (743)..(744): n is a, c, g, or t
  misc_feature (746)..(746): n is a, c, g, or t
  misc_feature (749)..(750): n is a, c, g, or t
  misc_feature (752)..(752): n is a, c, g, or t
  misc_feature (754)..(756): n is a, c, g, or t
  misc_feature (760)..(760): n is a, c, g, or t
  misc_feature (762)..(769): n is a, c, g, or t
  misc_feature (771)..(771): n is a, c, g, or t
  misc_feature (773)..(778): n is a, c, g, or t
  misc_feature (780)..(781): n is a, c, g, or t
  misc_feature (784)..(784): n is a, c, g, or t
  misc_feature (787)..(787): n is a, c, g, or t
  misc_feature (789)..(794): n is a, c, g, or t
  misc_feature (797)..(798): n is a, c, g, or t
  misc_feature (802)..(802): n is a, c, g, or t
  misc_feature (804)..(805): n is a, c, g, or t
  misc_feature (807)..(807): n is a, c, g, or t
  misc_feature (809)..(809): n is a, c, g, or t
  misc_feature (812)..(812): n is a, c, g, or t
  misc_feature (814)..(814): n is a, c, g, or t
  misc_feature (816)..(817): n is a, c, g, or t
  misc_feature (819)..(822): n is a, c, g, or t
  misc_feature (824)..(824): n is a, c, g, or t
  misc_feature (826)..(827): n is a, c, g, or t
  misc_feature (829)..(833): n is a, c, g, or t
  misc_feature (835)..(838): n is a, c, g, or t
  misc_feature (841)..(843): n is a, c, g, or t
  misc_feature (848)..(848): n is a, c, g, or t
  misc_feature (852)..(852): n is a, c, g, or t
  misc_feature (854)..(854): n is a, c, g, or t
  misc_feature (857)..(858): n is a, c, g, or t
  misc_feature (860)..(860): n is a, c, g, or t
  misc_feature (865)..(868): n is a, c, g, or t
  misc_feature (870)..(870): n is a, c, g, or t
  misc_feature (873)..(876): n is a, c, g, or t
  misc_feature (881)..(882): n is a, c, g, or t
  misc_feature (884)..(885): n is a, c, g, or t
  misc_feature (888)..(888): n is a, c, g, or t
  misc_feature (890)..(892): n is a, c, g, or t
  misc_feature (894)..(896): n is a, c, g, or t
  misc_feature (899)..(899): n is a, c, g, or t
  misc_feature (901)..(902): n is a, c, g, or t
  misc_feature (905)..(905): n is a, c, g, or t
  misc_feature (908)..(910): n is a, c, g, or t
  misc_feature (913)..(913): n is a, c, g, or t
  misc_feature (917)..(919): n is a, c, g, or t
  misc_feature (921)..(927): n is a, c, g, or t
  misc_feature (929)..(931): n is a, c, g, or t
  misc_feature (936)..(937): n is a, c, g, or t
  misc_feature (939)..(939): n is a, c, g, or t
  misc_feature (944)..(947): n is a, c, g, or t
  misc_feature (950)..(951): n is a, c, g, or t
  misc_feature (961)..(961): n is a, c, g, or t
  misc_feature (963)..(964): n is a, c, g, or t
  misc_feature (967)..(967): n is a, c, g, or t
  misc_feature (969)..(972): n is a, c, g, or t
  misc_feature (974)..(974): n is a, c, g, or t
  misc_feature (976)..(976): n is a, c, g, or t
  misc_feature (978)..(982): n is a, c, g, or t
  misc_feature (984)..(986): n is a, c, g, or t
  misc_feature (988)..(989): n is a, c, g, or t
  misc_feature (992)..(992): n is a, c, g, or t
  misc_feature (994)..(1013): n is a, c, g, or t
  misc_feature (1015)..(1015): n is a, c, g, or t
  misc_feature (1017)..(1017): n is a, c, g, or t
  misc_feature (1019)..(1020): n is a, c, g, or t
  misc_feature (1023)..(1023): n is a, c, g, or t
  misc_feature (1027)..(1029): n is a, c, g, or t
  misc_feature (1033)..(1033): n is a, c, g, or t
  misc_feature (1035)..(1035): n is a, c, g, or t
  misc_feature (1037)..(1038): n is a, c, g, or t
  misc_feature (1040)..(1040): n is a, c, g, or t
  misc_feature (1042)..(1046): n is a, c, g, or t
  misc_feature (1048)..(1049): n is a, c, g, or t
  misc_feature (1051)..(1052): n is a, c, g, or t
  misc_feature (1055)..(1055): n is a, c, g, or t
  misc_feature (1057)..(1058): n is a, c, g, or t
  misc_feature (1061)..(1065): n is a, c, g, or t
  misc_feature (1067)..(1068): n is a, c, g, or t
  misc_feature (1071)..(1071): n is a, c, g, or t
  misc_feature (1078)..(1080): n is a, c, g, or t
  misc_feature (1082)..(1082): n is a, c, g, or t
  misc_feature (1084)..(1087): n is a, c, g, or t
  misc_feature (1090)..(1092): n is a, c, g, or t
  misc_feature (1094)..(1094): n is a, c, g, or t
  misc_feature (1098)..(1098): n is a, c, g, or t
  misc_feature (1100)..(1100): n is a, c, g, or t
  misc_feature (1102)..(1103): n is a, c, g, or t
  misc_feature (1106)..(1107): n is a, c, g, or t
  misc_feature (1110)..(1110): n is a, c, g, or t
  misc_feature (1112)..(1113): n is a, c, g, or t
  misc_feature (1117)..(1118): n is a, c, g, or t
  misc_feature (1122)..(1122): n is a, c, g, or t
  misc_feature (1126)..(1127): n is a, c, g, or t
  misc_feature (1129)..(1131): n is a, c, g, or t
  misc_feature (1133)..(1133): n is a, c, g, or t
  misc_feature (1136)..(1136): n is a, c, g, or t
  misc_feature (1138)..(1140): n is a, c, g, or t
  misc_feature (1143)..(1145): n is a, c, g, or t
  misc_feature (1147)..(1149): n is a, c, g, or t
  misc_feature (1151)..(1151): n is a, c, g, or t
  misc_feature (1155)..(1155): n is a, c, g, or t
  misc_feature (1158)..(1158): n is a, c, g, or t
  misc_feature (1160)..(1163): n is a, c, g, or t
  misc_feature (1165)..(1165): n is a, c, g, or t
  misc_feature (1167)..(1167): n is a, c, g, or t
  misc_feature (1169)..(1169): n is a, c, g, or t
  misc_feature (1171)..(1171): n is a, c, g, or t
  misc_feature (1173)..(1173): n is a, c, g, or t
  misc_feature (1175)..(1175): n is a, c, g, or t
  misc_feature (1177)..(1177): n is a, c, g, or t
  misc_feature (1179)..(1179): n is a, c, g, or t
  misc_feature (1181)..(1181): n is a, c, g, or t
  misc_feature (1183)..(1184): n is a, c, g, or t
  misc_feature (1186)..(1186): n is a, c, g, or t
  misc_feature (1191)..(1193): n is a, c, g, or t
  misc_feature (1198)..(1198): n is a, c, g, or t
  misc_feature (1200)..(1202): n is a, c, g, or t
  misc_feature (1206)..(1206): n is a, c, g, or t
  misc_feature (1210)..(1210): n is a, c, g, or t
  misc_feature (1212)..(1213): n is a, c, g, or t
  misc_feature (1261)..(1261): n is a, c, g, or t
  misc_feature (1990)..(1990): n is a, c, g, or t
tnnanggngntactnccnnnntaaaaatantnnnantnacnggantnncattanctntntnagtnncngnnannnnanannntnnntnnntannnnnnnnacnancnnnnntanantcannnanattnncnntaatncnnnnnnnnntcnnantttnntnnnctananccgtnnctgntntaanananannncancnntnnnnnntnnnnnnnnnntngnntnnntnnccgttacnntcannttntttgtnnnnaatncnncnnntgnaannnnaatannngcnannnnanntnnnntngncnnanngntgtnntngncnatantnnngnnnnnattnttnannactacannnnnnnnancntnattngtnantntnnannntncatngnnccnnnncngnnnnngatnnnnatnancncnnnnntnnnnnntnnntnnntnnannnaannnnnnnnnnccnngntcananntnnnnnnnnnnnnnnannnnnngntnnnnnntnacnngtanctgnnntgnntntnagngtnnngnnnnnntnnnnnnnncnntnnanannnanaannnnnnncgnnnntnnnnnnnnnnnnnnnnngnnannggnntnnnnnntannnttnagtnnnnnnnnnntnnnnngnnnnnnnnnnnnannaannnnngnnnnncnngnnnnnncnggntngnnnanntnnnttnannnnantgtanncgntnnncnnnnnntnncnnnnnntncnntnaanncnannnttgncnnnnnnnntncnnnnnntnnaanttntnnnnnngcnntggntnngntngtntncnngnnnnangnnannnnntnnnnccnnntattnccgntnttnntncaaannnnantannnntaacnntnntantnnngnnnttngnntcnttnnngtntgtnnntnnnnnnncnnntctanntngttannnnatnnaaacaaattnannacnannnntntnannnnntnnntnnggntnnnnnnnnnnnnnnnnnnnnanananntantagnnncccnantnntngnnnnnanngnnggntnnttnnnnnannaanttattgnnngntnnnntgnnncntttngntnnggnnaantnntagnntccnattnngnnntnttngnnnagnnnannntngttnatncnnnnanancncntntngntnantnntntttannnaaaanannntacngcantnntcgatgttatgaggtacatatctagcgggcaagatgcccgcactacangagtttggtgatttaactttatacctcacaagaacagcaattctccgtattatgaggtacgtatctagcgggcaagatgcccgcaccacaagagtttggtgattagctttatacctcagaagagcggaaaatgctgtatcattgccctgggtggtgaggtatatactaatttattccctattccctacccagagtcaatttctcagcattttgctatgtctataaaaacactaagcaaaagtgaaattgttagcagtcagggtactagatgtaattcctagtaatgaagctaactccgtatttcctaccttaatcaaagtatcaccaccaacttgagataatgtcaaattagtgaactgagtagcagtagaaataccaccaataacaatgacatcagttcctaaagtgaaatcagtgacaatgtttttggttgtgggtaacgtagcattggcaatgtaaaacttgtcaatacctataccaccagttaagcggtttccaccaccagcaccagcaaataacacatcatcaccatcaccaccggataggtaatcattgatattagcgtaaagagtgtcatctccagaaccaccatagagacggttattattaccactactacggagagtatctttacctgaaccaccaaacaggaattgaccagaaccttcaactacttggaggttgtcatcaccagcagcgccgaacacattgttacttatgctactttgnactacgttgatcgtatcattaccattaccaccatctacattggtgttaccagcgggaccacttgcaccaatattgacagtatcattaccttccccagtaaatacggaagagtcactacttacagttacaaagtcgtcaccattaccagcattgattgtagccttaggtgcgctggattctactatatctgcaccgtcacccgtgaataaggtttgactagacagaatagtaatattgtcactaccagtagtaccagatttaaccacctcagcttgaggttgacctaaaccaggagctagatttagcggtttttccaacttcaacaaaatttgttcattgttatccactccagtccgaccaacagagaagggatagttgttgtcattggcaaccaaaatggtattcttgtcaagaaccagaacactctcaatggtttggaatgggaaaacaaaggtagttttaccatctccattgaggtcgttagggtccttaatgttcagtaggtctactacttcttcctttgtgacataaccattggtatctgctttggataaatcaaccttgtaaatccgcttaaataaagcagcagacccttgattattatcccgttcaatgactaggtactcattgtcattaatgactgttatatcaccaatggagttggctgtactctccagtttgtagtagagttttttgtcagtgtatttgcgagtagcaatgtcaaactcattaatccgcaaagcaccagcagcatcaccttgaaccgtcccctccaacagcatataaagcttagttttgctggcattaattgcgccaccctcaaagcccttagaaccacctagattagccacagccgttcctgccaatacatcaggattttggggagaacgaactatattatacaagggatcactaactagtttgtctctgacggtatctcctgtatcaggaaagtcagtgaagagtgcgtctacacctaattggaagaactgttggaactctagcttaggatcacccttgtaatctgcggctaaatactgtccctcattacggaaggtataaggatgaaccagcagacccgctttatgagcgtcttgaaccagggttgagggagctaatgttgttttatcagcatcattaactttaccgtctccattaacatcgtcagccttgccatcactattagcatcagtacctttaacactgacaatcatccgtttccaaggtccaatagcatcagcatatttagcaacattagctagaccttcggaagtccgtaaatcaccgtaagtaagagtgttattactaactttgaagtcataaggttgactttcaatgatcttgccattgatgtcaatatcctttgcatctaaaagttgcactaagggaatatttacacccgcagccggcatgatagtatcattcaattccttgaggttgctaacttcaaaagactggatgaaaatacggctaggatctgtaaaattatttgccttgagagtatctatgaggatctgacccagattgcggttaatcttggtagttgtacctacataggtagcttctgagagtgagtaggtgggatgcttggtttctgggtagataccaattttcttacctgtactagcttccactcccttaactaaggtaataatttccgtcagggtcggaatttcaaattgaccattaaaagactggtcacggaaggataggcgctcaattgcctttaattccttgatttccgctaaggtaaaatcttccgcaaaccaacctgtaactgatgttccatctaaaacaacggtctttttccggtctgcaaatttagcaatggtagcaacgttggtagttgtattaccagtatttaccgtaccatcagtattcaagattgctaaagcaggttcatgacgagcaatgagtacgccatcttttgtgacaactaaatcaggctcaataaagtcagcgcctttgtcaattgctaactggtaagcagctaaagtatgttcaggacga

SEQ ID NO: 1694 - DNA, 4000 bp, Escherichia coli
  misc_feature (1262)..(1262): n is a, c, g, or t
aagacgatctgattcatgtactgaaaaagccaataaaacgggtagtcagcaacccggttgaattgcagcgtatgacggaagaactttatcgactggcagcttctattgatatggctactactggcagtagttcatccagtatgggtatcagcaatcttgaacagatgctggaactgggggcgctaaaggatcccgaggccaatgatcaacatgtggttcgcatcgtcgactggcttctgcaatatgcttttgagcaaagggcaagtgatatacatattgaaccccgacgagaagtagggaatgttcgcttccgtatagacggagtactgtacacggtttaccagattcccatgcaggttatgaacgccgtaaccagccgcctgaaaattctggggcgaatgaatgttgctgataaacgcaagcctcaggatggtcgtctgaaaaccaagagcccggaaggcaatgaaattgagttgcgtctttccactttaccgacggcctttggtgaaaaaatggtaatgcggatttttgatccggatgtgctattacgttcctttgccgagttgggatttgatgatcaggatctggaaagctggcagaccatgatagccaggaaaaacggtattattcttatcactggtccgaccggtagcggaaaaacaacaagcctgtattccacgctcaagactctggccaccaaggaagtgaatgtctgcaccattgaagatccgattgaaatggttgaatccagtttcaatcaaatgcaggttcaggaaaatatcgacctgacctttgccggggggatcaaggcattactcaggcaggatcctgacattattatgattggtgagatcagggatctggagacagcggagatggctgttcaggcggcgcttaccggtcacctggttttatcatccttgcataccaatgatgctcctgctgccattacccgtttactggaactgggcgtgccttcctatctggtcagagcaacgctggtcggtgtggtagcccaacgcctggtcagaaccttgtgtccccattgcaaacaggaggcacagatcgatagcgagatctggaacgtgctggttaagccctggacagttcccatgcccaagaaggtttatcaacccgctggttgccaggaatgtcgggaaaccggcttcaagggcagacagggaatctatgaagtaatgcctttttcaccagctttacaggaatatgcagaagacaggggggatttaccccggctcaggttncatgcctataaagagggtatgcgcagtctcaggctcagcggtgcgctcaaggtggctgccggaataacaactgttaacgaggttctgcgtgtagctccggagagtcaataggcttgagtgccaaattgccagcaggcattgtggcgatgcccgaaagagatgtttttgccatgtttcttattataaaactgataaccgataaacccggacaagtgagtaagggcgcatgaagatccttattatcggtccttcctgggtaggcgacatggtgatggcgcaaagtctgttcatcagcctgaaacaaattgttcctgatgttgaaatacatgtgcttgctcctggctggtgcaaggctctgcttgatcatatgccgcaaatcagccgtgctattgaaatgactattggtcatggtgagctggccattggcaggcgcagggtattggccagttcactgaagcaggagaattatgaccaggcgatagtgcttcccaattccttcaagtccgcactcattccctggtttgccggcattcccgtcagaacaggttggcgtggtgaagccagaagctggttgcttaatgactgcagagtgctggacaagcaagcccatccgttgatggtggagcgttttattgctctggcttacccggatggaacggccttgccctctgaattgccgcgtcctgagcttgaagtaaaggcagactcccttgtgtcgctgttaaatacactcacactggatacccaaaagccggtgctgatactttgtccgggtgctgaatttggtgaggctaaaaaatggccggcatcaggttatgctgccgttgccagccactggttgtctcaagctggccaggtctggatcatgggttcggctaatgacagcaaggatgcggggaaaattatcaacgccttgccagagccagaccccgaacactgcattgatctgaccggtaaaactaccctgggggaagcgattgacctgatgtcctgtgctacccgtgtggtcagtaatgattccggtctgatgcatattgccgctgcactgaagcggccccaggttgtaatatacggatcaacttccccgacgtttactcctccacttgcagataaagtccagatagtttccctggaactggagtgtagcccttgtttcaagcgagtctgcccattgggacataccaactgtctgaaattacttgaacctgaccaggtcattcgctctttgcatgagctggattcaccatgaaagtcgcactggtattgtttaactggtttccccacggcggtttgcagcgtgactgcctgggtatcgccaacagcctgattaagcgaggacttgaagtagacgttatatgtatgagttgggaaggcagtgtgcccgagggcatcaatcgggtaattccctccttcaaagtaaaaaacaaagtggcggcaagaaaagcctttgccgaatttgtcttgcagataactgccgcggaagattacctgacggtgctcggctttaaccgtttgcccgggctggattactactttgccgccgatacctgttttgcctggaaggccactcgggaaagaggctggctttaccgaatggcaccgcgaagtcgccaatacctggcatttgaagaagcagtctttgggccacaaagtgagacaaaaatattaatgctctctccggggcagcaagacgagtacctggcctgttatcccaaggctggtaaacgcatgataaatattcctcccggtatcgaaagaaatcgtatggccggggaagatgcgacagcgctgaggcaatcgttgcgtcatgaatttggtataactgacgatcagttgctggtactgcaggtcggatcaggattccctgtaaaaggcgttgagcgctctctggcagcgctggcctcattgcccgaagcacctggaaaccagacaagattatttattattggtagagacgactctcagcgttatgaaaaaatagctgaaaaaatggggatagcagcaaatgtcaccttttttaaaagtcgtgatgatttgccgcgcttttatcagggggccgatctccttttacacccttcggtaaaggaaagtgccggcatggtgttaattgaggccatcgttgccggcttgccagtcctgacaacggcttcctgtggctatgcttttcatgtcaggcaggcgcaggcgggtgttgtcattactgagccattcagccagcaggcactaaatgaagcgctgaaaaaaatgctgaagagcaaagataaaagtcgttggcgcactaatggtatagcctacggacaaaaagagaatctctatgatatgccagatgcggtagcatcaatgctgttaaacgcaatcggggaggccaatgatggcaactgatgtctttatcagagaagacctgcagccacatctgccgaaggaaaatatctttgcgtttatcgccgggatggagggcgaagaattccgtgcgctggaatccaggcgaactattgctgtcgatctggatggcaaacgttattttgtcaaatatcatcgcggtaccgctactgcagaaattctgaagaacctcttacagttgcgcttgccggtggtgagtgcccgcaatgaatggcttgcgctttcccgcctcgatgttctgggcatcaacgttccgcaaatagccgcctatggaaagcgtggtctgctaccccagacatgcgaatcctttatcgttaccgatgatgtaggcactcagg

SEQ ID NO: 1695 - DNA, 4000 bp, Escherichia coli
  misc_feature (260)..(260): n is a, c, g, or t
  misc_feature (1198)..(1198): n is a, c, g, or t
  misc_feature (1623)..(1623): n is a, c, g, or t
  misc_feature (1646)..(1646): n is a, c, g, or t
  misc_feature (1651)..(1651): n is a, c, g, or t
  misc_feature (2114)..(2114): n is a, c, g, or t
  misc_feature (2716)..(2716): n is a, c, g, or t
  misc_feature (2767)..(2767): n is a, c, g, or t
  misc_feature (2773)..(2773): n is a, c, g, or t
  misc_feature (2971)..(2971): n is a, c, g, or t
  misc_feature (3577)..(3577): n is a, c, g, or t
  misc_feature (3784)..(3784): n is a, c, g, or t
  misc_feature (3952)..(3952): n is a, c, g, or t
ttgatacaactgattccacctgatcttctgataaactgccgtccttgttatcaccaagaagtctcgatagaaggaggatactatttaaaggagttctcagctcatgggacatattggccaggaattcagatttgtatttactgctctgttccagatcacgtgctctatcttcaatagtttttctggcagctttcaggtcctcattcttcctttctacatactctttctgttcctctatttcttcattggtttgacgtagntcttcttgttgagcctgcagtcttgattcagagtcttttaatgcaattgcattttcttcaagctcttcattgctttgacgaagagcctcttcacgtgcctgaagttcttctgcttgttgctgtgtctgttccagaaggatctcggtgctgtttctggatataaccgtattcaaggcaactgcaatgccctctgcaacctgagtcagaaaagttagatggatatcctggaattcgttaaaagagcctagttcaacaacactgcttactgcgttattcaatattagcgggaagatcaggatctgttttggtgtggcttctactatgcctgaattaatgttgatagaattgtcaggaaagtctgttaaaagaatatgtctcttttccaatgccgcctgacctaccagaccctcaccgggcataaattcattcggggtattcttctgctgaacataggcaaaactacctattggtttaagacgcttgtcatcaccagacatatatagtatcccaacctgtgcattcaaatattcagccagatgcccaatgatatttccacccaatgcttcaatgtcctgttcgcctcgcatttttacattcagttccatctggccagtcttgagccagttatgggtatcatttttttctgtcgtcaggcgtaagttagagatcatgtcattaaagctgtctgctagttctccgatttcacctctggtctttatctcaatattgtgatcaagttcgccttccgcaacacttctaactgcccttgaaagtgctgtgattggtttggttatacttcttgctacaaaaaagcataatataaacattgctattgcagagccgcctgtcaaaccggaatagatgataacagagattgttttttcagaggataaatctgttgcttctttaagaatttcctgaagttgtgcatcttcganttttttcaaatcgttaatgcgtcctgctgtgatggcaaagacgtattcaggtttcagtccaaaattgccactcgtaagattttcactgatttgcttgcgtatattcatgacagccttaatatttggctcactcatttttgtgtgatactcatttcgtattctttctgtaatctggtattcaaaaactgagagtaatgcttcctgccctttagatacccgcatccagtcatgcatttctgattgagtgacaggtttgtcttcagcaacaagacccgttataattgctctctccttgcccgccatctctttggccatgataaggttgatacaggccgtaaatggaaatgaaagttcagagtccttgataataacactcgcttcttgaaatgtccccagaatgtcatctattatttcatcatagaggncattggcttcattgttttcgatngacantgaagagatcttttctctgatagagggcagtttccagagttttcttgaggacgcattggctcgcctggcaaatttatagccaagctttgccatatccaatgtttttgtgtccttgtccatgactttataatacctgtctgtaagcagtctctgcttcttcattgtctcttccatgctgcttccactactggcaatgaatccggcagatgctccacgttctctctgtaattggtgaacaacctgactggaaactatcatataatctgcgatactcttgatctgctcagcctgtttttttgcatcaaattcacgaagcaatagaattgccatgaacccgcccactatcagggccgggatcaatgccaatacaatcagctgttttatcagtcctaatcctgaagattgtttagattctttctgctttgtgtgaagatcggagtttttcatttcaaattcctgtcgngttcaagtggaatagatttttgataatggttattagtgaaaacggtaaaatagtgatagctcttttcataattcagtcttttaactctaatttccaaatatctgaattttatgtctatagggttatcttaattttcggccattttggtgttttcttgatatggaaaattgaattgtagttttcaattaaatgcgggccatttgaagagattgttttgttggtatccagtccataagtacataaatcctgggaaatcgtaaccagctgaagcctgtaaactaaacttgattgttcgatcaccaagtagattgcccattgagccttcaaaaatttctgccagattaaatgctcttttgtattttataactttcgcttcgtttaaacctgttatgtccttggcgagagtgattgcgtcttcaatatagcccaattggtcgaccaatccattttccaatgcctgcactcctgtatatattctgccatctgacaactttctaacatcttccagttccatatttctaccagcggcaataatatttataaaccttgtatacatttcatctacaatgtcatacaagaccttcctttcagcgtcagacatntttttaagaggtgagccaatactcttcatatctcctgattttatcgaattntcctgnatgccgtatttctcagcaagattagcaatattgataagaggcatgattactccaatacttccggtaattgtcgtcggatgagaaattattttatctgcagcggctgaaatgtaataggcgccggatgccgcaacgtcctgcatgcagacgattactttcttatttgtttgttctttaaattccaggacttttttgtanataatatcgcttgctgttattcctccaccaggactgttgatttccaatatcacagcttttatcgcattgtcgtcccgtgcttgcttaagttgctgtttcacactatcaacaatgcttggtgtttcctggaaaagtttctttgatgattgcccggtaataacacccttcactggaattagaagtattttgtcagtaccgcttcctcctattactgtttcggaaagtttcttggtgctttcatcttcaacctgtgttgttagtgcgccctttactacgaagagtcccatgaacgaaatggataacacaatacagcaaagaaaaaagaatattgccaatgaagttgaaacccaaaaacctactctgctttttttcttattatcttccataatacgattttataaccgggtaaataatgtgttaacgtgatactaatatgtttctctgtttgttgattcctatgtagtcattaattcagaatccatgtatccccagtctccatagctctttctggtatacggcggatactcaattccaatgtagtcaagtgccttacctaccatgaaatctacctgatcgtttatagtctttggatggtagtagtatccnggcatagcaggtaagatacaggtttgcgcttttgacaacttcaacatgttttccagatgtattggagttaatggagtctctcgcggcatgacaaccaatttccttccctcctttagtgtaacacttgcagcacgttgaatgagatttgacgcaataccatttgctattgaacagagtgtgttcatactgcacggtgctataatcatngctttggtttttaatgtgccgcttgagatggatgctgcaatatctgatatgtggtgataggttatgctgtgactttccctatcaataaatttactgatattgaactcatttatatctaaggagagatttaattcactttctataacttgtatagcggcttctgacacnattaagtgaacagtatatgatttatcgctcagcgcttgtaagaggcgc

SEQ ID NO: 1696 - DNA, 4000 bp, Escherichia coli
  misc_feature (1)..(6): n is a, c, g, or t
  misc_feature (8)..(8): n is a, c, g, or t
  misc_feature (10)..(13): n is a, c, g, or t
  misc_feature (15)..(21): n is a, c, g, or t
  misc_feature (23)..(33): n is a, c, g, or t
  misc_feature (35)..(41): n is a, c, g, or t
  misc_feature (43)..(48): n is a, c, g, or t
  misc_feature (50)..(56): n is a, c, g, or t
  misc_feature (58)..(71): n is a, c, g, or t
  misc_feature (73)..(89): n is a, c, g, or t
  misc_feature (91)..(93): n is a, c, g, or t
  misc_feature (95)..(96): n is a, c, g, or t
  misc_feature (98)..(112): n is a, c, g, or t
  misc_feature (128)..(128): n is a, c, g, or t
  misc_feature (138)..(138): n is a, c, g, or t
  misc_feature (144)..(144): n is a, c, g, or t
  misc_feature (215)..(215): n is a, c, g, or t
  misc_feature (222)..(222): n is a, c, g, or t
  misc_feature (225)..(226): n is a, c, g, or t
  misc_feature (230)..(230): n is a, c, g, or t
  misc_feature (235)..(235): n is a, c, g, or t
  misc_feature (239)..(239): n is a, c, g, or t
  misc_feature (241)..(241): n is a, c, g, or t
  misc_feature (246)..(246): n is a, c, g, or t
  misc_feature (248)..(248): n is a, c, g, or t
  misc_feature (255)..(255): n is a, c, g, or t
  misc_feature (262)..(262): n is a, c, g, or t
  misc_feature (266)..(266): n is a, c, g, or t
  misc_feature (268)..(268): n is a, c, g, or t
  misc_feature (270)..(270): n is a, c, g, or t
  misc_feature (273)..(274): n is a, c, g, or t
  misc_feature (278)..(278): n is a, c, g, or t
  misc_feature (291)..(291): n is a, c, g, or t
  misc_feature (294)..(295): n is a, c, g, or t
  misc_feature (297)..(297): n is a, c, g, or t
  misc_feature (302)..(302): n is a, c, g, or t
  misc_feature (306)..(308): n is a, c, g, or t
  misc_feature (310)..(310): n is a, c, g, or t
  misc_feature (316)..(317): n is a, c, g, or t
  misc_feature (335)..(335): n is a, c, g, or t
  misc_feature (337)..(337): n is a, c, g, or t
  misc_feature (339)..(339): n is a, c, g, or t
  misc_feature (342)..(342): n is a, c, g, or t
  misc_feature (347)..(348): n is a, c, g, or t
  misc_feature (354)..(354): n is a, c, g, or t
  misc_feature (357)..(357): n is a, c, g, or t
  misc_feature (361)..(362): n is a, c, g, or t
  misc_feature (365)..(365): n is a, c, g, or t
  misc_feature (367)..(367): n is a, c, g, or t
  misc_feature (372)..(372): n is a, c, g, or t
  misc_feature (376)..(376): n is a, c, g, or t
  misc_feature (379)..(379): n is a, c, g, or t
  misc_feature (383)..(383): n is a, c, g, or t
  misc_feature (387)..(387): n is a, c, g, or t
  misc_feature (390)..(390): n is a, c, g, or t
  misc_feature (393)..(393): n is a, c, g, or t
  misc_feature (395)..(395): n is a, c, g, or t
  misc_feature (398)..(400): n is a, c, g, or t
  misc_feature (403)..(403): n is a, c, g, or t
  misc_feature (408)..(408): n is a, c, g, or t
  misc_feature (414)..(414): n is a, c, g, or t
  misc_feature (417)..(417): n is a, c, g, or t
  misc_feature (419)..(420): n is a, c, g, or t
  misc_feature (423)..(424): n is a, c, g, or t
  misc_feature (428)..(428): n is a, c, g, or t
  misc_feature (431)..(432): n is a, c, g, or t
  misc_feature (434)..(437): n is a, c, g, or t
  misc_feature (443)..(444): n is a, c, g, or t
  misc_feature (448)..(449): n is a, c, g, or t
  misc_feature (452)..(453): n is a, c, g, or t
  misc_feature (457)..(457): n is a, c, g, or t
  misc_feature (459)..(460): n is a, c, g, or t
  misc_feature (462)..(463): n is a, c, g, or t
  misc_feature (465)..(469): n is a, c, g, or t
  misc_feature (471)..(473): n is a, c, g, or t
  misc_feature (475)..(475): n is a, c, g, or t
  misc_feature (477)..(477): n is a, c, g, or t
  misc_feature (479)..(481): n is a, c, g, or t
  misc_feature (483)..(483): n is a, c, g, or t
  misc_feature (486)..(494): n is a, c, g, or t
  misc_feature (496)..(497): n is a, c, g, or t
  misc_feature (500)..(502): n is a, c, g, or t
  misc_feature (508)..(514): n is a, c, g, or t
  misc_feature (516)..(516): n is a, c, g, or t
  misc_feature (518)..(519): n is a, c, g, or t
  misc_feature (523)..(527): n is a, c, g, or t
  misc_feature (529)..(529): n is a, c, g, or t
  misc_feature (532)..(535): n is a, c, g, or t
  misc_feature (537)..(539): n is a, c, g, or t
  misc_feature (541)..(543): n is a, c, g, or t
  misc_feature (545)..(545): n is a, c, g, or t
  misc_feature (548)..(550): n is a, c, g, or t
  misc_feature (552)..(553): n is a, c, g, or t
  misc_feature (555)..(557): n is a, c, g, or t
  misc_feature (559)..(560): n is a, c, g, or t
  misc_feature (562)..(566): n is a, c, g, or t
  misc_feature (568)..(569): n is a, c, g, or t
  misc_feature (572)..(579): n is a, c, g, or t
  misc_feature (582)..(585): n is a, c, g, or t
  misc_feature (588)..(590): n is a, c, g, or t
  misc_feature (592)..(600): n is a, c, g, or t
  misc_feature (602)..(604): n is a, c, g, or t
  misc_feature (608)..(611): n is a, c, g, or t
  misc_feature (613)..(614): n is a, c, g, or t
  misc_feature (616)..(626): n is a, c, g, or t
  misc_feature (629)..(634): n is a, c, g, or t
  misc_feature (636)..(636): n is a, c, g, or t
  misc_feature (638)..(638): n is a, c, g, or t
  misc_feature (640)..(641): n is a, c, g, or t
  misc_feature (643)..(643): n is a, c, g, or t
  misc_feature (645)..(649): n is a, c, g, or t
  misc_feature (651)..(658): n is a, c, g, or t
  misc_feature (660)..(667): n is a, c, g, or t
  misc_feature (669)..(669): n is a, c, g, or t
  misc_feature (671)..(671): n is a, c, g, or t
  misc_feature (673)..(673): n is a, c, g, or t
  misc_feature (675)..(675): n is a, c, g, or t
  misc_feature (677)..(678): n is a, c, g, or t
  misc_feature (680)..(683): n is a, c, g, or t
  misc_feature (686)..(696): n is a, c, g, or t
  misc_feature (698)..(705): n is a, c, g, or t
  misc_feature (707)..(707): n is a, c, g, or t
  misc_feature (709)..(709): n is a, c, g, or t
  misc_feature (711)..(712): n is a, c, g, or t
  misc_feature (714)..(716): n is a, c, g, or t
  misc_feature (719)..(726): n is a, c, g, or t
  misc_feature (728)..(731): n is a, c, g, or t
  misc_feature (733)..(735): n is a, c, g, or t
  misc_feature (738)..(738): n is a, c, g, or t
  misc_feature (740)..(741): n is a, c, g, or t
  misc_feature (743)..(746): n is a, c, g, or t
  misc_feature (748)..(752): n is a, c, g, or t
  misc_feature (754)..(760): n is a, c, g, or t
  misc_feature (762)..(762): n is a, c, g, or t
  misc_feature (764)..(764): n is a, c, g, or t
  misc_feature (766)..(766): n is a, c, g, or t
  misc_feature (768)..(770): n is a, c, g, or t
  misc_feature (772)..(772): n is a, c, g, or t
  misc_feature (775)..(777): n is a, c, g, or t
  misc_feature (781)..(782): n is a, c, g, or t
  misc_feature (785)..(785): n is a, c, g, or t
  misc_feature (789)..(791): n is a, c, g, or t
  misc_feature (793)..(794): n is a, c, g, or t
  misc_feature (796)..(798): n is a, c, g, or t
  misc_feature (804)..(806): n is a, c, g, or t
  misc_feature (808)..(808): n is a, c, g, or t
  misc_feature (811)..(811): n is a, c, g, or t
  misc_feature (813)..(813): n is a, c, g, or t
  misc_feature (815)..(818): n is a, c, g, or t
  misc_feature (823)..(825): n is a, c, g, or t
  misc_feature (829)..(830): n is a, c, g, or t
  misc_feature (833)..(834): n is a, c, g, or t
  misc_feature (836)..(836): n is a, c, g, or t
  misc_feature (839)..(839): n is a, c, g, or t
  misc_feature (842)..(848): n is a, c, g, or t
  misc_feature (850)..(850): n is a, c, g, or t
  misc_feature (852)..(857): n is a, c, g, or t
  misc_feature (859)..(859): n is a, c, g, or t
  misc_feature (861)..(861): n is a, c, g, or t
  misc_feature (866)..(866): n is a, c, g, or t
  misc_feature (868)..(869): n is a, c, g, or t
  misc_feature (871)..(874): n is a, c, g, or t
  misc_feature (876)..(879): n is a, c, g, or t
  misc_feature (881)..(881): n is a, c, g, or t
  misc_feature (884)..(886): n is a, c, g, or t
  misc_feature (888)..(892): n is a, c, g, or t
  misc_feature (895)..(895): n is a, c, g, or t
  misc_feature (899)..(901): n is a, c, g, or t
  misc_feature (905)..(905): n is a, c, g, or t
  misc_feature (908)..(909): n is a, c, g, or t
  misc_feature (911)..(916): n is a, c, g, or t
  misc_feature (918)..(918): n is a, c, g, or t
  misc_feature (920)..(920): n is a, c, g, or t
  misc_feature (922)..(923): n is a, c, g, or t
  misc_feature (926)..(927): n is a, c, g, or t
  misc_feature (930)..(932): n is a, c, g, or t
  misc_feature (934)..(937): n is a, c, g, or t
  misc_feature (939)..(942): n is a, c, g, or t
  misc_feature (945)..(945): n is a, c, g, or t
  misc_feature (947)..(954): n is a, c, g, or t
  misc_feature (956)..(960): n is a, c, g, or t
  misc_feature (962)..(964): n is a, c, g, or t
  misc_feature (967)..(968): n is a, c, g, or t
  misc_feature (970)..(970): n is a, c, g, or t
  misc_feature (972)..(973): n is a, c, g, or t
  misc_feature (976)..(976): n is a, c, g, or t
  misc_feature (978)..(978): n is a, c, g, or t
  misc_feature (980)..(984): n is a, c, g, or t
  misc_feature (986)..(986): n is a, c, g, or t
  misc_feature (988)..(988): n is a, c, g, or t
  misc_feature (990)..(991): n is a, c, g, or t
  misc_feature (993)..(997): n is a, c, g, or t
  misc_feature (1000)..(1002): n is a, c, g, or t
  misc_feature (1004)..(1004): n is a, c, g, or t
  misc_feature (1006)..(1006): n is a, c, g, or t
  misc_feature (1008)..(1010): n is a, c, g, or t
  misc_feature (1012)..(1012): n is a, c, g, or t
  misc_feature (1015)..(1017): n is a, c, g, or t
  misc_feature (1019)..(1019): n is a, c, g, or t
  misc_feature (1021)..(1028): n is a, c, g, or t
  misc_feature (1032)..(1036): n is a, c, g, or t
  misc_feature (1040)..(1040): n is a, c, g, or t
  misc_feature (1043)..(1043): n is a, c, g, or t
  misc_feature (1045)..(1045): n is a, c, g, or t
  misc_feature (1049)..(1050): n is a, c, g, or t
  misc_feature (1052)..(1052): n is a, c, g, or t
  misc_feature (1054)..(1058): n is a, c, g, or t
  misc_feature (1065)..(1072): n is a, c, g, or t
  misc_feature (1076)..(1076): n is a, c, g, or t
  misc_feature (1079)..(1080): n is a, c, g, or t
  misc_feature (1086)..(1086): n is a, c, g, or t
  misc_feature (1088)..(1088): n is a, c, g, or t
  misc_feature (1090)..(1092): n is a, c, g, or t
  misc_feature (1094)..(1095): n is a, c, g, or t
  misc_feature (1097)..(1102): n is a, c, g, or t
  misc_feature (1104)..(1105): n is a, c, g, or t
  misc_feature (1109)..(1109): n is a, c, g, or t
  misc_feature (1117)..(1117): n is a, c, g, or t
  misc_feature (1133)..(1133): n is a, c, g, or t
  misc_feature (1180)..(1180): n is a, c, g, or t
  misc_feature (1187)..(1187): n is a, c, g, or t
  misc_feature (1450)..(1450): n is a, c, g, or t
  misc_feature (1689)..(1689): n is a, c, g, or t
  misc_feature (2501)..(2501): n is a, c, g, or t
  misc_feature (2917)..(2917): n is a, c, g, or t
  misc_feature (3144)..(3144): n is a, c, g, or t
  misc_feature (3461)..(3461): n is a, c, g, or t
  misc_feature (3777)..(3777): n is a, c, g, or t
nnnnnngncnnnnannnnnnngnnnnnnnnnnnannnnnnncnnnnnncnnnnnnncnnnnnnnnnnnnnngnnnnnnnnnnnnnnnnncnnncnnannnnnnnnnnnnnnncctaaacctcttcaanaggtatttgntatttngcatagggtaagaaccaatgctcgcagctctccaagacatctttaagaagaaccatagacattaaatcttntcgtccnttnngtcnatatncttnanagagncnctcatcnactcggntaancntntcnnttangtcgcatttttcnttnncnaggtngtannngncgatgnnttttacatggaggaaaanancnccnaaatnnaaagcnacncacnnggnantgccntttncantgcnccanccngtntntcnnnggncattnaagaantcnannagnntttngcnntnnnnggtggnntttnntanncctntnnanncnnnnntnnnancntnnntnatnnnnnnnnnannacnnntgtctnnnnnnntngnngctnnnnngnttnnnnannnannngntannnannannngnnannnnncnntgnnnnnnnntcnnnnagnnntnnnnnnnnngnnncatnnnnannannnnnnnnnnnccnnnnnntntntnncntnnnnngnnnnnnnnannnnnnnngntnancntnncnnnnaannnnnnnnnnncnnnnnnnngntngnngnnntcnnnnnnnntnnnntnnnggnannannnncnnnnntnnnnnnntncncncnnngnagnnncctnntcnttgnnncnncnnntctttnnncnganantnnnnaactnnnggannatnntnccntcnnnnnnngngnnnnnnantnctttnanntnnnnannnncnccnnntnnnnnganatcnnnatgnccnntnnnnnntntntnngtnnctnnntnnnntnnnnaancnnnnnnnnannnnnannngtnntncnnctntntnnnnncntntnntnnnnnttnnntntnannnanatnnntngnnnnnnnnaaannnnncttnttntntganntnannnnnttattannnnnnnntttnttnncttcgnangnnnannannnnnnanncttnatttgtcnttaacaaattgccccncgaccatcttaccagtcctgtctttgatctcatcgtaagccaactgnaaacaanaagtgctctcaagatcaaccatttcagctgcaataataatggtcaccaacatatctccgataccatcggccacctcattctctaatgcttctattgttttggcgtgaacatgactaggctcgcgatccatcgcttgatgccagtctcgtagattttttacagcaagaattgtttcttcaagttcttcctgtgttttgtctaactgagctaaagtatctccattatcaaagatacctcggtcttttgcccaaccgattaccttnctttctaattcggaaaaattattcatcttcttcaagtccttcgaatagtttctttttttctcgttcgtattcttctagagcgtgatcctctgcggtcattttgaaatcgccaaacgtagacgttgacccatctaagccaaatatttttttaatttgtttgttgtcaactacaggcatctccgaaacatcaagagagtcatcaactaaaactttcttaggggcgatttcctgtaattcgncacacatagagaagatttctcttttgcttattagctcgccgctcaatgacatgcgcctcaacttgtcaacttctttgcaaaaattaatataatccaactcttggacaatccgcttctttaaatgactatcataaataaaggcatcaaacgcctcataacgttcattaagcaaataattttcatcaagggaaacctcaacgggatggtaaccagactcccccaaaacatacctgaggacatcttgtttgcggacttgaatcgcttgttctttcatcaacgcccacaatagagagttttccccccgtgtcaacaaaaatctacagaattcttattctgcttctaatcttagaaacatgtctgtttttttctaagactgagccgccctctcggctccctgctccattagtattaccctcaatggttttcacatagccccttgaatctacgtctgcgatagcgatagcgatatgagaaaaagtaaaaactataatgtctccagcattaatgtcctcgttggtgggtttgcgaagccccactccattcgcggcttgttgtttagcccagttttcaaagtcccatgcccccgctgttctgggtcttgagaatttcacatcctcaccctctatagcctcccttacaagccagcagatgaaagccgcgcaccaaggccatcctttatcggcgtcgagccatgtcgccgccttgtattcgtctaccttggggccacaattagttccatctacctcggaaacaccaatctctccacgggccaacgataccatcttctcgggtatgctgctcccagaaatcgngggttccttggtggataatttggccagtatagcgttccaagttactggaccgtctgctccatcactagaaacacccaaaagtctttggacggcctttactacctctcttttacctttaaaattcattatttaaatttctttttaaggaattttaacgggcgcttttcaaactttttggccaaacaaacaattcctccgattacttctggacttactgcaccaattataccatacgttattgccttcataagggatgaaacctctgtttgttctaggacaaaccaagcaattcctgcggcaattgcagcggttgcaatctttttaaactgctccttaacagtaaggtggttagtgccagtcagaagcctagcaaacatagcagcagccccgattaaaggaacaagccaccccccacnaagaaactcttttattatagacttttcgggttccatgttaaactaattacactttctacgaaaaaagccccccattagggggactttttatttcgtttttaaaagatttatcttagaacctgaaagaaacccctccaccaaccgaccaatcatgctctaaagcataagcactagaagaatcaagatcattgtcatgataagccgccttcacaaagagagagagactntcattaagctcataggtggctgcgaccccagcttctaccccatcatactcgtcagcaatattaactgccgcaaatggagtaatagtaagattcgccacgggagtagcgaaatcgcgagaaaccatcacttccaccccataagggccagacgaatcagcttcgtgccacacggtagccgtgaggtcagcaatatcgtgggcataagttagcgcaagaccaacctcttcccaacccccattagaggaatcaatcctcttgagatgcgctctagcgcccaagctctgaccaaaaatctcaattggacgagcataagcaanagaccaatctttctctgtatcgccatcaacatcgtgaaggtcaatacccacagaaagatgcgctccctcaacgggaattcccacaagggcagaaaaagcaagagaatcttctcttgtggctacgccacgatgagtcgataaattgctatagttaacgccaagctcaggagaaacactctccaagagattagtgatagtaacacctgcgttaccaagggtaacgcccaacatggttgcaagactaaataatagtgtcttcatatttttgtattattaacggtttaaagcgattgtcaaattaattttacacattctntgtcataaaagagaatataagggcttatttttattatctacatgtgaatacgtattcatcgctgtcgctattttttccccaccttttttattaatctccaaacttgatatcggtctttatcttttcccattgctgcctcaatggctctcctcgtaatgcttttatcagaagcggtgaaggtcacctcttggaaacgaggcttgtcacttttaataatgtttat

SEQ ID NO: 1697 - DNA, 4000 bp, Escherichia coli
  misc_feature (1)..(2): n is a, c, g, or t
  misc_feature (6)..(7): n is a, c, g, or t
  misc_feature (10)..(11): n is a, c, g, or t
  misc_feature (16)..(17): n is a, c, g, or t
  misc_feature (20)..(22): n is a, c, g, or t
  misc_feature (24)..(24): n is a, c, g, or t
  misc_feature (26)..(26): n is a, c, g, or t
  misc_feature (29)..(29): n is a, c, g, or t
  misc_feature (31)..(32): n is a, c, g, or t
  misc_feature (34)..(38): n is a, c, g, or t
  misc_feature (44)..(44): n is a, c, g, or t
  misc_feature (47)..(47): n is a, c, g, or t
  misc_feature (50)..(52): n is a, c, g, or t
  misc_feature (54)..(56): n is a, c, g, or t
  misc_feature (59)..(63): n is a, c, g, or t
  misc_feature (65)..(68): n is a, c, g, or t
  misc_feature (70)..(70): n is a, c, g, or t
  misc_feature (72)..(74): n is a, c, g, or t
  misc_feature (76)..(78): n is a, c, g, or t
  misc_feature (80)..(80): n is a, c, g, or t
  misc_feature (82)..(82): n is a, c, g, or t
  misc_feature (85)..(86): n is a, c, g, or t
  misc_feature (94)..(94): n is a, c, g, or t
  misc_feature (97)..(97): n is a, c, g, or t
  misc_feature (101)..(102): n is a, c, g, or t
  misc_feature (106)..(106): n is a, c, g, or t
  misc_feature (113)..(113): n is a, c, g, or t
  misc_feature (115)..(116): n is a, c, g, or t
  misc_feature (120)..(120): n is a, c, g, or t
  misc_feature (125)..(126): n is a, c, g, or t
  misc_feature (128)..(130): n is a, c, g, or t
  misc_feature (137)..(137): n is a, c, g, or t
  misc_feature (140)..(140): n is a, c, g, or t
  misc_feature (144)..(144): n is a, c, g, or t
  misc_feature (146)..(148): n is a, c, g, or t
  misc_feature (151)..(151): n is a, c, g, or t
  misc_feature (156)..(156): n is a, c, g, or t
  misc_feature (160)..(160): n is a, c, g, or t
  misc_feature (567)..(567): n is a, c, g, or t
  misc_feature (619)..(619): n is a, c, g, or t
  misc_feature (726)..(726): n is a, c, g, or t
  misc_feature (1152)..(1152): n is a, c, g, or t
  misc_feature (1257)..(1257): n is a, c, g, or t
  misc_feature (1351)..(1351): n is a, c, g, or t
  misc_feature (1477)..(1477): n is a, c, g, or t
  misc_feature (1497)..(1497): n is a, c, g, or t
  misc_feature (1986)..(1987): n is a, c, g, or t
  misc_feature (2058)..(2058): n is a, c, g, or t
  misc_feature (2563)..(2563): n is a, c, g, or t
  misc_feature (2590)..(2590): n is a, c, g, or t
  misc_feature (3073)..(3073): n is a, c, g, or t
  misc_feature (3097)..(3097): n is a, c, g, or t
  misc_feature (3366)..(3366): n is a, c, g, or t
  misc_feature (3558)..(3558): n is a, c, g, or t
  misc_feature (3583)..(3583): n is a, c, g, or t
  misc_feature (3586)..(3586): n is a, c, g, or t
  misc_feature (3616)..(3616): n is a, c, g, or t
  misc_feature (3628)..(3628): n is a, c, g, or t
  misc_feature (3631)..(3631): n is a, c, g, or t
  misc_feature (3640)..(3640): n is a, c, g, or t
  misc_feature (3691)..(3691): n is a, c, g, or t
  misc_feature (3739)..(3739): n is a, c, g, or t
  misc_feature (3795)..(3795): n is a, c, g, or t
  misc_feature (3817)..(3817): n is a, c, g, or t
  misc_feature (3829)..(3829): n is a, c, g, or t
  misc_feature (3838)..(3838): n is a, c, g, or t
  misc_feature (3880)..(3880): n is a, c, g, or t
  misc_feature (3904)..(3904): n is a, c, g, or t
  misc_feature (3964)..(3964): n is a, c, g, or t
  misc_feature (3979)..(3979): n is a, c, g, or t
  misc_feature (3991)..(3991): n is a, c, g, or t
nnaagnngcnncagannttnnngnanaantnntnnnnnaaactnaanaannngnnnaannnnntnnnntnannnannntngnttnnaaaaaggnttngaanncgtnaaataantnnttanttaannannnagaactnatnagangnnnccnttcgngggngcctcttttgtatataatatagttaactatatgtggaatttattttattgtatcttaaattaatgcggtcatttcttgaatagctagttcctgaattactaatgctttcacaataggtaatatactaggaatttggtataatattaaatagttgtgcatatactactaggtatattgtactgatatatgatttgataactttaatagtaaacatagaggtgcttatggctaaggataatcaacagatcgcaacagacgatatgcaacaaacaatatataaagagttaggctataaatcctatccatttccttttactacacctgcctatttggaagcgtatggtacacttgtaggtcttaagccaccaacggctaaaacagcacgtgtacttgaattaggtgctacntatgggggaaatattatttctcaagctgtgcataatccagaagcaacatttntaggtattgagctttcccaagatcaagtagagaagggcaacaaaattattagtgatgccaagttagataatgtatctctattgcaaggggatattttgaactttgangaatccttaggaaactttgattatattattgcccatggtttttactcttggattagcgatgaaatgaaggataagttgcttgatattatatcccatcatttggctgataatggcattgcatatgtatcctataatacatacccaggttggcatacgatggaagaggttcgtcaacttatgctatttgctaatcgtggttatgatgagttgactcataaggaaaaggtattacgcggtaaaactgtaggtagtctagtaggtgctcaaattcttaattatgataaccttaaagagcgtaatagtaaattcttaggtgccttgcgttccgttatgcaaaaggatgattattatgtaggtcatgaccatttagaacctcataatgatccatgttacttctatcaattcaatgatcatttaaaagctcanaatcttagctatgtatgtgatgcagatttaacattatccatggttcgtacctatgatgaaagcatcgccgataaacttgaaaaattggctcctaatagccaagcngatcaagaacaatatttagactttatgcttgatacaacattccgcaagtctattatttgcaaagaaagtgctgcaaaggatattagctatgatntagctaatccagataaggtgaatacagtacctgtacggtctatcgtaaatagttttgtattccaaatcctctttgatgaagaagcattaaaaatgtttgaaaatgagcttgtacgagatacattcnaagcgctcattaaagatggnggcactttcaatatgatcgaagcccttgccattttaaaagctgctcatgatactgctaatgcatctgaagatgacttagaaccagctgtatgtagtttatataaagctatcgttgaacatatggtacgcggtggtattcgattctataaaacattccctgataaacaggaatatatggagggcttatcctatgtaccagctcgttttacaaactttgtaaaagctattgctgatggtggtagtgaatatatttatggtgcaaatatgttcaatgacgctattggtgatatttctgaagaagatttattgttcatggaattattgaataagcctaaagccaagtctacgatgattaagaagattaaagattctctctttagcgctgataaggcccaaactggtaaacaccaaaatgccatggcggaagcattctataatgaattgacgaagcgtatggagcaattaggctttattagaagtaagaaaaannatggtctttcgtaattcttttaaaatttctaagataatattttggtgattcatataatcttcagaataaanataaaacccattatacttataacatttatgtgtattaagtagtaatgggtttttgttttatataatttaatttaatcttttttaataattattacatttagttatttaatattgccaaaaaagtatagtaaatcgataaaattaatgagaaataaatgaaccatatatgaaaagtgtggtatactatgtatgggtatttttgtgaacatcatccgatgtgttgtggatgatattataaattgtattagttacaatgttgtttttattgtattatttgtaaaaggagtcttttatggcatctaagaaggccgttctagtatatatactagaaatcctgaaaagtgaaacggatgctaatcatactttatctcaagaggagattcgcagtatattagccgagcggtacgaggtatccgtcgatcggaagaccttaggccgtcatttaaatgatttatatgaatctggtgattttggtattcaatgtgaagagtctgccgtaggagcngatggtactattcgccgtactgatttntatatgattcatacctttgaagattcagaattgagattattaattgacggtattttggcgtctcgtcatattaccgcatctcaacgtaaggatttaattagtcgtgttgctaaattgggtagctctcatttcaagccccatggtattgatattgaaagtgctacgggttaccttcatagaagtcaggacttattccttaacattgatctcatagaggaagcaatacaaaaggggagaaaaatttccttggcttattgccaacctgacgtggataaacgattacatatcaatctcggtccagataataaggagcgaaagtatgtattcaatccattccaactagttatgaatcggggacactattacctagttgggaaccatgaaaattatgatgacatgtctacattgcgtgtcgatcgaattgcacacattacggtgctgagcgaacgtagaaaacctttacgggagataaagggctataancagcaacgcacctttaatgtatcncaatatgtaaaagaacatatttacatgttcggcggtgaatccgttaccgtaagttttaaggcaaagcggtctattgtaaaccaaattttagattggttcgatggcaatgtggaattcaccaacgtcacatctgatgatgttgtatgccgtgtacgtgtaaatcatgatgcctttaagtattgggcacttcaatatatgcaaagtgtgaaagtactttcaccagcatccttggtagcagaagtgaaagaagctattaaggaaggcttagnacaatactcataataaaagagctagttgatcgttgaatcaactagctctatttttatgtatgctattttaaacgtccgatttctaatttatagaacatgcattttttctgcttcgcgatagtccttaagaactggacgaggaggtaatttacccatgatactcactacatagatagcgatggaagagaagangaagcctggcacgatttcgtaaagnccnaggaatccaaattgtttccaaatgagtacngttaaaccaccnacnacgataccngcgatacagccatgacgtgtcatacgtttccagaataaggagaacaagatngctggaccaaaggcagcaccaaaacctgcccatgcataggcaaccatngttaagatgtagctatctggatccattgccatatagatggctattaatgcaactantagtactacgatacgacttacnagtactagctcnttatcactngctttaggatgaatgatattcgcatagaagtcattagaaatngcagaggctgttactaataactgngcagatgcggtactcatgatagctgcgagtactgcagaccagatgagacctgctacaaanggtgtaaagagacgntctgtcatgatnaggaataca

SEQ ID NO: 1698 - DNA, 4000 bp, Escherichia coli
  misc_feature (1987)..(1987): n is a, c, g, or t
  misc_feature (1989)..(1990): n is a, c, g, or t
  misc_feature (1992)..(1992): n is a, c, g, or t
  misc_feature (1996)..(1996): n is a, c, g, or t
gacggggttacccaaaccatcaccatgggctcttacggcatcggcgtaggccgggccatggcggcggccgccgaaacccaccacgacgaaaatgggttgcaatggcccatggccatcgccccttacgaggtggtgattaccgtggtaaaaaccgaccacgaagagtccatggctgccgcagaaagcgcctacgccgagttccaggccgcaggcgtagacgtcttgttggatgaccgccctggccgacctggtgtcaagttcgccgatgctgaactcattggtatcccgttgcgcctcaccgtgggtcctcgcggcttagaaaacaatcaactcgagttcaccgatcgtcgagacggtacgaagtctgacttggttcttgaccaagccacccagcacataattgatctggttaaccaaggccgacgtttaggcgcctgaccttcgctgccatccgctagattcttttccgaccgacccctgccgaggttttacatgactaaaacaatcgaccgccaactccccttgaaacgccgccaaaaagtagtggcctcgcttgacctccccggtgttcccgaaggaaccgaaggccaagtcaaggtagctaatggcatcacttggtaccgctattgggttgactttgctaacggcatcaccttggggtcagtaagccacgaacaactggcacaaaaaaatgattggccgcaatttaaaatcgaccgcgagaacgatactttgaacgcggaaatcaaagccggtgaagaagcggcaacagaaacagccagcgatggtgcagccagtgggaatacctctggtgtgcctgaacatcttttagaacgcagccgggccgctcgtgctcgcctcggcgcttaacactctttagcgtccggactgtccccatttggggtatcctcagacgttcctgcaatgctcacggaggctcccgttgacctttaaacctggcgacaaggtcgtctacccgcaccatggtgcggcgattatcgacaaagtacagaagcgtaaagcttttggcaaaaatactgaatactttattttgactatggcccacggcgatatgaccctttcggtgccggttgacatggtcgaagaggtcggtatgcgctggcccatcagtaaagaagacgtggtcgatctctttgatgtactacaaaaacgcgatattcgtgaaccttccaactggtcacgccgttttaaaaaccatcaagaaaaacttaaaagtggcgacgtctatcaagtagccgaagtggtacgaaacttggctttgcgtgatgccgctaaaggactttcggccggcgaaaaaactttgtacaccaaagccctaagcgtgcttgtttctgaattggcttttgcccttgacgtagaagaagacgaagcgagcgccaaggtcgcagacgctctttcctaattgcctcttggtgaatggttcgctctgtattacgctcaaggtgaaccaacaattagcaaagggatgacatgaccaagcgtcgcatagtggtaggtgttgagggttcagggtatgcccgggccgctttaatctgggcttttgaagaagctgcgctgcgtgactccattgttgaggtggtgacggcctatgccccaacctatgtgcccgctgcgccagatttaggttatgtgccgcttgattcttacgacctcattaatgaggtcgaacgcatgcaaggtgaagttatagattctgcgcttgaagccgctggtcatcccgaggttgaaattgtgcggacgctaaccaaaggccgagcggccgacacgcttttgcaggccgctaaagacgctgaccttttagtagtcggcaatcggggtcgcggcggttttgccgggcttcgcctagggtcggtaagccaatctattgcccatcacagcccttgcccattggtgattattcatacgggtttagacaacgaggactgaattatttctgttccgggggctctgggcggtcagagccganannancttnttgacgcttttgaaagcacatcctttgatttggtgatcattggtggcggcatcaccggtgccggggtggctcgggcggctagccaacgtggtttatcggtggcattactggaggctaaagatttctcttcgggtacttcttctaagtcttctaaacttattcatggcggtctgcgctatttagcaatgggccattttcgggtggtgcgccacacggcacgtgaacgggcggtggttcatgctttagctccccatctttgtgaaccgcactggatggtttttccggtggcttcccggcgctggctagtgcttatggatgtcgtggtccggatttacgaaatgttgggcggggttaagcgctccgatcgccatcgtcgttggggtcgagccgaagtggcacaaaacgagcccgctttacgagcagaaaaaagtcgttacgccgtaacttttcgcgagtatctgaccgatgactgccgcttggttctggccaatttgcgtgatgcggtggcttctggtgcccaagtcgctaattacctttctgtcgatggcctgctgggcgaaaaccaggcagaaggggttactgctcagtgtgcgcttaccggccggtcgattcaggtaaaagccgcggtggtagttaacgccaccggcccgtgggttgatgccacccgccaactggaagccgatgttgagcctcgtttggtactcagtcgcggcattcacgtggctgtccggcgcaccgatttaccggtcaacaacttggtgaccatgaccggttcagatggccggccggtgttcgccctgccgcgaggaccggttacgtatttgggaactaccgatactcgtcatctcgaaccagcaacccaccatccatcggttgaacagattgatgtggattttttgttaactaccgttgaggatcatttcgatatttctttgaccccaaagcaagtgaccggggcatgggctggcctacggccgttgatctctaaaccggagcaaaccacttcggaactttctcgcaaagacgaagtatgggtcggcccccgaggggttgtcacggtggccggtggcaaacttaccggttacctccaaatggccgacgatgtccttgagtctgtagatactcaactctctgcccagcagagcttgaactccagtgccgtctttagtgggacaacttctacctctaagaccttgcccggtggagacattgcttcagacttgtctttggctgcgcaaactttagcagccgaccatgaccttgctttgcccattgccgagcgtttggtgcgacgctacgggtcggaaaccgaagcggttattaccctcggaaaagaaccggtggcccccggggcgcatcttttgtcgggtgaaatcgtgtgggcggtgcaagtggatggtgcgctctttttagacgatgtgttggtgcgacgcaccggaagcatgtggtttgatccagaggttggggttttgattgaaccggtagctgagcagttagctggtttgcttggttggacttctgagcaaacatctgagcaaatttctctgctagaaagacagcaagaaaccgatttaacatttatttaggggagtccaatgactgaagtagtagcggttgattcaccggtgggcttactttgggtagcccacgacgagggaactattgtggccagcacgttggctgggtcaacgcactcccctacttttgcaccgtatcttgatttgcccctagccaagaaagcaccggctgggctggttaacgccattgctcaagcgtttacccacaaaggggcaagcgacttgccttttgatcagcgcctcggcaccgattttcagcgcttggtgtggaaaaactgtactttgatcccatctggagaaacccgcacttatcaagagttggcgcaagccctgggtcgccccaaagccacgcgtgcggtgggtactgcgctcggagcgaacccctttcttgttttggttccctgccaccgagtgttgcgagccgatg

SEQ ID NO: 1699 - DNA, 4000 bp, Escherichia coli
  misc_feature (1968)..(1968): n is a, c, g, or t
  misc_feature (1980)..(1980): n is a, c, g, or t
  misc_feature (1984)..(1984): n is a, c, g, or t
  misc_feature (1986)..(1986): n is a, c, g, or t
  misc_feature (1991)..(1991): n is a, c, g, or t
cgactgtcgagatcgctcatcagcagcgcgaattcgtcaaagtccatggattgcgagccatcaacgtctatcgcggcgaagagctcgcgggcgactcgcatcgacgccgcgtctcgaccgccaatcatctgccacgtcgtgacgaactctgagaattcaacctcaccgccaccgtcggcgtcgagcgcatcgaaaagttcacgaagttgcgcacgtttacgttcgccgagcgtctttttcatgagtttgcgccgtttgagcatccacgccgcggtttgcgccttgagctcgcgtcgtcgaaacgacgcgcaggcgtctgcgcgagacgcgtcacggcgacacgcgtcgatcgagcgcaagtccgagcgaagccgggtgattacatcgagtacattcgatgctttgtcgtcgacgagcgcgagttcgcgatccatgcggtgttgtggggaagagtcaaagaatgaggcgactggcgctaaaaatggctattcgaattcttcgggcaaagaaaaaatgaaacgcgcgtgcgatcggcgggacgctttgccctaggacacgcgaaactcgtgccatcgggtccgtgcccgtcgcgatcgcgtgggtcgagctcgtccacggtgataaattcgtcatcgagtcggcgcgtcaactcggcgcccacgaagagctccacgagcgtcgaatctccatccgcctcggcgtcttcctcttcgtacgcctcgagccaatccaagcgcacgagcgccgagttcttctcagcgtaagcgcgaagaaatgattcgtcattcgcgaagacgagcgccgaaagagaaacttcgtcgatggacggcgcgctttcgagaacgcccgcgctgagaggcgaatcgagcgcgcggtcgagctcggcttcagattttcctgcgtcttcatatatcgctcccgtggtcacgcgagcgactgtttccatgagccacatcacatcctgaacgtcttggtgcgactgcgcgagcgacatcggccacggcgtcgacgcttcccgccacgccgggatgacgacgtacggcagcgcgcatcgatccgccgcgtcggcggcgactttaaatttcgccgtcgccccgaccgcggccccgagcgaaatctggcagcatccgtaccgacgcaactcgcacatcatgtccatcgttttcgtcgcgcccacgctcgttcgaaggcgcctcgcgatgctgacaaagtctgtaattttccgctcgatgaacatcgcccgcccgcacgcgtcatacgtctccagcgcgctatcgtcgctatcatcagactcatccgcgtacgcgttcacatccaccgcattcataccttcgggatatcccagttgtttgctcagcctttcttccgcgactttgtgtctcgcgcgtttcgcttccaatttcgcctcgcgtctcgcgcggcggcgttcaatctcgtcgtcttcctccgcgacctcgaccgcgcgccgcgcctcagcctcagccgcttccgcagccttccgctcgtccagttccacgcgcgcgcgcaatttcttcatcacggcttcgcactcatcccgatcttgtccgcactcgtcgcatcgaatcgcctcggcgtacgcgctcagcgcctccacctccgccccgctcgccgcgcgcgcttgccccaaccgaaaccacgccttatgccacgtcggcgcgttcctcacgcacgccctcgcgtcttccagcgctcgcgccgcgtcgccgtcctcaccccgtcgcaaccgcgccagcgctcgattacacagcgcaaactgattccgcgcgtcgatctccagcgcgcgcgtgaagcacgcaatcgcttcgccgtaatccccccttccgtacgcctcgctccccgcgacgtgtttcgcgcgtcccgcgcgcatgacgcgcgcgcgctcgaacggcgtccacgtcttcgccatgcgtcgccgtctcccgcgcgtcgtcgcgcgccgtcgcgccntcgacgcgcgcncgcngncttcntcgcggcgaccgttactaaaaaaacgctccgaaaatcacgacgcgaccgcggcgaccgaccgaggtgcggtcgacgaccgatcgcgccgacgcgcgagtcgccgacgcgcgcgcgcgatgccgcgcgcggcgatcgccgacgcggtgctccgcgtcgtcgtcctgctctacccggggtacctgacgtacaagacgctcgagcacgaccgcaagcgcgcggacaacgcgcgcgggtggtgcgtgtactgggtcgtcgcgagcgcgtggatggcggcgcagccggcgctggatcgcgcgttcgggggacgagcggtgatgtattgggagtgtaaggtgcgccggtgaccgccgggacgggacgggacgcgcgcgacgcgcggacgcgcgcggaggattcgaatatcgaaggactgacgcgcgcggcgcaggtggcgtttagcgtctatctctggcatccgaggtttcagggcgcgctgtacgtgtacgataggttcttagcgccgatcttggtcgcgaacgagtcgcgcgtcgatcacgcgctggcgacgacgttcgagcgcgtcgggacgcacgggggcgcggcgctcgccgccgcgcggcggttcgcgcgacggtacgcgaacgacgcgctcgccaaggcgaccgaggcgcagttacagcagcaagccgacgcgcccgcggcgagcggacgcgctgatagagtagtcaccgcgcgcaccgcgagggaggtgcgctcgtagacgacgtcatcgtcgtaagtttgtatcggagcgtcgtctcgtcttcccctcgcgcgcgctcgtcgtctcgtcactcacccgcgcgacgtcgccatgccctcgagcgcgcgtccgacgatggtcggcgccgacccgatcgccgcgccgctcgcgcacgtcgccctgctgctctgcgcgctcgcgccgaccgtcgcggtcgtcgatcccaacgcccagatcgtcgccgtgagcacgctgagcgtcgtcgccggcgcgtaccgaagcgtgcgaccggcgagcgagggctcgggagaggtcatgaccaaggaagacgcgcaaaagttccctctgctcgggtcgtgcgtgctgttcggggcgtttctggcgttcaagtttttgcccaaaaacgtgctcgacgtgtgcgcgacggcgtactttgggatgctcggcgtcgtggcgatgagcgcgatcctgaccccggtcgtgcacaaatttgcgttcgggggacgcgagctcgtgagctacgaactgttttcggtgccggagatgaagtgggtgaacggcgagcggtggacggcggagtgcacgctggcggaggcggcggcgggcgtcgcggcgttggcgggaacggcggcgtacgttcgttcgcgtcattggttggcgaataatgcgctgggaatgtcgtttgcgctgcaaggaatcgagtatttgacgattgatagcgtgcagatcgggtcaatcttgctcgcggggttgttcgtgtacgacgtgttttgggtgttttgcacgccggtgatggtgagcgtggcgcggtcgttcgacgcgccgatcaagctacttttcccgcgagtcgccgccagtgcgatcgagggcgctgatggaccgtttagcatgctaggtctgggggatatcgtcgttccagggctttacgtggcgatgattttgaggatggacaacgcgagacgcgcggcggcgctcgagccgagaaagtcgctcacgagatcggcgtccaaaaaagctgcgaccgcctctcgaacggtccgcgacgacggaaagactgtgacaacgtatttccccgccgtcgcgttcggctatctcgtcgggatcgtcaccaccatcgtcgtcatgaacgtctttgacgccgcccaaccggcgctgttgtacatcgtcccgggcgtcctcggcgccaccttcattcgcgccgctctggcgaaagaagtcggcgtgacgtggaattactgcgaaggattagaagaggcccaggccgagcgcgacgccgcggaagccaag

SEQ ID NO: 1700 - DNA, 17 bp, Escherichia coli
tcgtccggccgttggct
